(12) United States Patent
Faber et al.

(10) Patent No.: US 11,739,144 B2
(45) Date of Patent: Aug. 29, 2023

(54) HETERODIMERIC ANTIBODIES THAT BIND CD3 AND CLDN6

(71) Applicant: Xencor, Inc., Monrovia, CA (US)

(72) Inventors: Matthew S. Faber, Glendora, CA (US); Sung-Hyung Lee, San Gabriel, CA (US); Yoon Kyung Kim, Pomona, CA (US); Jing Qi, Arcadia, CA (US); Kendra N. Avery, Hawthorne, CA (US); Seung Y. Chu, Upland, CA (US); Alex Nisthal, Monrovia, CA (US); Matthew J. Bernett, Monrovia, CA (US); John R. Desjarlais, Pasadena, CA (US); Chad Borchert, Nowthen, MN (US)

(73) Assignee: Xencor, Inc., Pasadena, CA (US)

( * ) Notice: Subject to any disclaimer, the term of this patent is extended or adjusted under 35 U.S.C. 154(b) by 36 days.

(21) Appl. No.: 17/690,702

(22) Filed: Mar. 9, 2022

(65) Prior Publication Data

US 2022/0289839 A1   Sep. 15, 2022

Related U.S. Application Data

(60) Provisional application No. 63/158,584, filed on Mar. 9, 2021.

(51) Int. Cl.
| | | |
|---|---|---|
| *C07K 16/28* | (2006.01) | |
| *A61P 35/00* | (2006.01) | |
| *C07K 16/46* | (2006.01) | |
| *C12N 15/63* | (2006.01) | |

(52) U.S. Cl.
CPC ............. *C07K 16/28* (2013.01); *A61P 35/00* (2018.01); *C07K 16/2809* (2013.01); *C07K 16/468* (2013.01); *C12N 15/63* (2013.01)

(58) Field of Classification Search
CPC .. C07K 16/28; C07K 16/2809; C07K 16/468; C07K 2317/24; C07K 2317/31; C07K 2317/33; C07K 2317/54; C07K 2317/55; C07K 2317/622; C07K 2317/73; C07K 2317/92; A61P 35/00; C12N 15/63; A61K 2039/505; A61K 2039/507
See application file for complete search history.

(56) References Cited

U.S. PATENT DOCUMENTS

| | | |
|---|---|---|
| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |
| 4,361,650 A | 5/1982 | Asai et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |

(Continued)

FOREIGN PATENT DOCUMENTS

| | | |
|---|---|---|
| CN | 107840891 A | 3/2018 |
| EP | 0425235 B1 | 9/1996 |

(Continued)

OTHER PUBLICATIONS

U.S. Appl. No. 12/631,508, filed Dec. 4, 2009, Chari et al.

(Continued)

*Primary Examiner* — Nelson B Moseley, II
(74) *Attorney, Agent, or Firm* — Louis-Vu T. Nguyen; Christopher J. Betti; Morgan, Lewis & Bockius, LLP

(57) ABSTRACT

Provided herein are novel CLDN6 binding domains, and anti-CLDN6×anti-CD3 antibodies that include such CLDN6 binding domains. Also provided herein are methods of using such antibodies for the treatment of CLDN6-associated cancers.

5 Claims, 137 Drawing Sheets
Specification includes a Sequence Listing.

(56) References Cited

U.S. PATENT DOCUMENTS

| | | |
|---|---|---|
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,834,597 A | 11/1998 | Tso et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,177,078 B1 | 1/2001 | Lopez |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Mateo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 7,850,962 B2 | 12/2010 | Teeling et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 9,181,334 B2 | 11/2015 | Kobayashi et al. |
| 9,822,181 B2 | 11/2017 | Bonvini et al. |
| 9,856,327 B2 | 1/2018 | Bernett et al. |
| 10,227,410 B2 | 3/2019 | Moore et al. |
| 10,428,155 B2 | 10/2019 | Moore et al. |
| 10,526,417 B2 | 1/2020 | Bernett et al. |
| 11,066,483 B2 | 7/2021 | Nezu et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reft et al. |
| 2003/0017979 A1 | 1/2003 | Mack et al. |
| 2003/0091561 A1 | 5/2003 | Van de Winekl |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0100543 A1 | 5/2005 | Hansen et al. |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0004195 A1 | 1/2009 | Vranic et al. |
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |

(56) References Cited

U.S. PATENT DOCUMENTS

| | | |
|---|---|---|
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0121597 A1 | 5/2012 | Ho et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0056879 A1 | 2/2014 | Lazar |
| 2014/0072581 A1 | 3/2014 | Dixit et al. |
| 2014/0086916 A1 | 3/2014 | Zha |
| 2014/0161790 A1 | 6/2014 | Desjarlais et al. |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0119555 A1 | 4/2015 | Jung et al. |
| 2015/0307628 A1 | 10/2015 | Kim et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2016/0355608 A1 | 12/2016 | Bernett et al. |
| 2017/0020963 A1 | 1/2017 | Qu et al. |
| 2017/0320947 A1 | 11/2017 | Moore et al. |
| 2018/0118828 A1 | 5/2018 | Bernett et al. |
| 2018/0118836 A1 | 5/2018 | Bernett et al. |
| 2018/0127501 A1 | 5/2018 | Bernett et al. |
| 2018/0305465 A1 | 10/2018 | Stevens et al. |
| 2019/0010244 A1 | 1/2019 | Sahin et al. |
| 2019/0106504 A1 | 4/2019 | Wu et al. |
| 2019/0263909 A1 | 8/2019 | Bernett et al. |
| 2019/0270816 A1 | 9/2019 | Bernett et al. |
| 2019/0314411 A1 | 10/2019 | Xiao et al. |
| 2019/0345252 A1 | 11/2019 | Kinsella et al. |
| 2019/0382495 A1 | 12/2019 | Bernett et al. |
| 2019/0389954 A1 | 12/2019 | Bernett et al. |
| 2020/0339677 A1 | 10/2020 | Sahin et al. |
| 2021/0102002 A1 | 4/2021 | Bernett et al. |

FOREIGN PATENT DOCUMENTS

| | | |
|---|---|---|
| EP | 1752471 | 2/2007 |
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| EP | 3199628 A1 | 8/2017 |
| EP | 3252078 | 12/2017 |
| EP | 3339326 A1 | 6/2018 |
| RU | 2014114179 A | 10/2015 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO1997024373 | 7/1997 |
| WO | WO1997044352 A1 | 11/1997 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005103083 A2 | 11/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO 2006124641 A2 | 11/2006 |
| WO | WO2006106905 | 12/2006 |
| WO | WO2006131013 | 12/2006 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007042309 A2 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO2007145941 A2 | 12/2007 |
| WO | WO20070147901 | 12/2007 |
| WO | WO2008003103 | 1/2008 |

(56) References Cited

FOREIGN PATENT DOCUMENTS

| | | |
|---|---|---|
| WO | WO2008003115 | 1/2008 |
| WO | WO2008003116 | 1/2008 |
| WO | WO2008048942 | 4/2008 |
| WO | WO2008119096 | 10/2008 |
| WO | WO2008119566 | 10/2008 |
| WO | WO2008124858 | 10/2008 |
| WO | WO 2008143684 A1 | 11/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009087978 A1 | 7/2009 |
| WO | WO2009089004 | 7/2009 |
| WO | WO2009106096 | 9/2009 |
| WO | WO2009106321 | 9/2009 |
| WO | WO2010022737 A1 | 3/2010 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |
| WO | WO2010151792 | 12/2010 |
| WO | WO2010151808 | 12/2010 |
| WO | WO2011005621 | 1/2011 |
| WO | WO2011028952 | 3/2011 |
| WO | WO2011036183 | 3/2011 |
| WO | WO2011066342 | 3/2011 |
| WO | WO2011051307 | 5/2011 |
| WO | WO2011063348 | 5/2011 |
| WO | WO2011066501 | 6/2011 |
| WO | WO 2011097603 A1 | 8/2011 |
| WO | WO2011121110 | 10/2011 |
| WO | WO2011131746 | 10/2011 |
| WO | WO2011133886 | 10/2011 |
| WO | WO2011143545 | 11/2011 |
| WO | WO2011154453 A1 | 12/2011 |
| WO | WO2011159877 | 12/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013018892 | 2/2013 |
| WO | WO2013022855 | 2/2013 |
| WO | WO2013023251 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013059885 A2 | 5/2013 |
| WO | WO2013063702 | 5/2013 |
| WO | WO2013070565 | 5/2013 |
| WO | WO2013096828 | 6/2013 |
| WO | WO2013125667 | 8/2013 |
| WO | WO2013164694 | 11/2013 |
| WO | WO2013173820 A2 | 11/2013 |
| WO | WO2013180201 | 12/2013 |
| WO | WO2014004586 | 1/2014 |
| WO | WO2014012085 | 1/2014 |
| WO | WO2014018572 | 1/2014 |
| WO | WO2014047231 | 3/2014 |
| WO | WO2014055897 A2 | 4/2014 |
| WO | WO2014056783 | 4/2014 |
| WO | WO2014075697 A1 | 5/2014 |
| WO | WO2014075788 A1 | 5/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014151910 A1 | 9/2014 |
| WO | WO2014164553 | 10/2014 |
| WO | WO2014207064 | 12/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015095423 | 6/2015 |
| WO | WO2015103072 | 7/2015 |
| WO | WO2015130728 A1 | 9/2015 |
| WO | WO2015143079 | 9/2015 |
| WO | WO2015149077 | 10/2015 |
| WO | WO2015168379 | 11/2015 |
| WO | WO2015184207 | 12/2015 |
| WO | WO2016014984 | 1/2016 |
| WO | WO2016028672 | 2/2016 |
| WO | WO2016028896 | 2/2016 |
| WO | WO2016040294 A2 | 3/2016 |
| WO | WO2016079050 | 5/2016 |
| WO | WW2016071355 A1 | 5/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016110584 | 7/2016 |
| WO | WO2016115274 | 7/2016 |
| WO | WO2016120789 | 8/2016 |
| WO | WO2016141387 | 9/2016 |
| WO | WO2017072366 A1 | 10/2016 |
| WO | WO2016182751 | 11/2016 |
| WO | WO2016210223 A1 | 12/2016 |
| WO | WO2017019846 | 2/2017 |
| WO | WO2017021356 A1 | 2/2017 |
| WO | WO2017023761 A1 | 2/2017 |
| WO | WO2017055391 A1 | 4/2017 |
| WO | WO2017112775 | 6/2017 |
| WO | WO2017134158 A1 | 8/2017 |
| WO | WO2017210443 | 12/2017 |
| WO | WO2017210485 | 12/2017 |
| WO | WO2017214092 | 12/2017 |
| WO | WO2017220990 A1 | 12/2017 |
| WO | WO2018005706 | 1/2018 |
| WO | WO2018017863 | 1/2018 |
| WO | WO2018041838 | 3/2018 |
| WO | WO2018054484 A1 | 3/2018 |
| WO | WO2018209304 A1 | 11/2018 |
| WO | WO2019050521 | 3/2019 |
| WO | WO2019065964 A1 | 4/2019 |
| WO | WO2019104075 A1 | 5/2019 |
| WO | WO2019173324 A1 | 9/2019 |
| WO | WO2019195623 A2 | 10/2019 |
| WO | WO2019224718 A2 | 11/2019 |
| WO | WO2019242505 A1 | 12/2019 |
| WO | WO 2020023553 A1 | 1/2020 |
| WO | WO2020025792 A1 | 2/2020 |
| WO | WO 2020033702 A1 | 2/2020 |
| WO | WO 2020/191344 * 9/2020 ............. C07K 16/30 |
| WO | WO2020196474 A1 | 10/2020 |

(56) References Cited

FOREIGN PATENT DOCUMENTS

| WO | WO2020196712 A1 | 10/2020 |
|---|---|---|
| WO | WO2020236797 A1 | 11/2020 |
| WO | WO2021008463 A1 | 1/2021 |
| WO | WO2021011885 A1 | 1/2021 |
| WO | WO2021026387 A2 | 2/2021 |
| WO | WO2021111003 A1 | 6/2021 |

OTHER PUBLICATIONS (No Author Name) "A method for making multispecific antibodies having heteromultimeric and common components", Expert Opinion on Therapeutic Patents, Genentech, Inc. (1999) 9(6): 785-790, pp. 785-790.

"Polythene Glycol and Derivatives for Advanced PEGylation", Catalog 2005-2006, Nektar Therapeutics.

"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.

Abbott Laboratories, Strategies and Current Approaches for Improving Drug-Like-Properties During Biologics Drug Candidate Selection, AAPS Webinar—Nov. 10, 2011.

Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.

Alberola-Ila et al., Stimulation Through the TCR/CD3 Complex Up-Regulates the CD2 Srface Expression on Human T Lymphocytes, Feb. 15, 1991.

Alibaud et al., A New Monoclonal Anti-CD3? Antibody Reactive on Paraffin Sections, Journal of Histochemistry & Cytochemistry, 2000, vol. 48, p. 1609.

An, et al., IgG2m4, an engineered antibody isotype with reduced Fc function, mAbs, 2009, vol. 1, Issue 6, pp. 572-579, www.landesbioscience.com/journals/mabs/article/10185.

Aplin et al., , Preparation, properties, and applications of carbohydrate conjugates of proteins and lipids, 1981, CRC Crit. Rev. Biochem., pp. 259-306.

Arnett, et al., Crystal structure of a human CD3-ε/δ dimer in complex with a UCHT1 single-chain antibody fragment, PNAS, 2004, vol. 101, No. 46, pp. 16268-16273.

Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.

Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, p. 27659-27665.

Atwell, et al., Stable Heterodimers from Remodeling the Domain Interface of a Homodimer using a Phage Display Library, J. Mol. Biol., 1997, vol. 270, pp. 26-35.

Baca et al., Antibody humanization using monovalent phage display, 1997, J. Biol. Chem. 272(16):10678-10684.

Baeuerle, et al., Response to Letter, "Correct TandAb protein," Molecular Immunology, 2007, vol. 44, p. 3084.

Baeuerle, et al., Review—Bispecific T-Cell Engaging Antibodies for Cancer Therapy, Cancer Res, 2009, vol. 69: (12), pp. 4941-4944.

Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.

Bargou et al., Tumor Regression in Cancer Patients by Very Low Doses of a T Cell-Engaging Antibody, Science, 2008, vol. 321, pp. 974-977.

Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.

Bhatt, Sea Lane—DDD presentation, "Surrobodies™ —A Novel Approach to Bispecifics . . . ," Aug. 8, 2012.

Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.

Biochemica, Your apoptosis specialist, 1999, No. 2, pp. 34-37 (Roche Molecular Biochemicals).

Bird et al., Single-chain antigen-binding proteins, 1988, Science 242:423-426.

Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.

Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.

Bortoletto, Nicola et al., "Optimizing anti-CD3 affinity for effective T cell targeting against tumor cells.", Eur J Immunol. Nov. 2002;32(11):3102-7.

Boswell et al., Effects of Charge on Antibody Tissue Distribution and Pharmacokinetics, 2010, Bioconjugate Chem, 21(21):2153-2163.

Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.

Brinkmann , et al., presentation slideshow—"Roche Penzberg & Roche Glycart, Schlieren: Centers of Excellence for Recombinant Proteins".

Brinkmann, et al., A recombinant immunotoxin containing a disulfide-stabilized Fv fragment, Proc. Natl. Acad. Sci. USA, 1993, vol. 90, pp. 7538-7542.

Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.

Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.

Carter et al., Antibody-drug conjugates for cancer therapy, 2008, Cancer J. 14(3):154-169.

Carter et al., Humanization of an anti-p185HER2 antibody for human cancer therapy, 1992, Proc Natl Acad Sci USA 89:4285-9.

Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.

Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.

Chames et al., Bispecific antibodies for cancer therapy—The light at the end of the tunnel?, mAbs, 2009, vol. 1, Issue 6, pp. 1-9.

Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.

Chari et al., Immunoconjugates containing novel maytansinoids: promising anticancer drugs, 1992, Cancer Research 52: 127-131.

Chatal, 1989, Monoclonal Antibodies in Immunoscintigraphy, CRC Press (Book Abstract).

(56) References Cited

OTHER PUBLICATIONS

Chelius, et al., Structural and functional characterization of the trifunctional antibody catumaxomab, mAbs, 2010, vol. 2, Issue 3, pp. 309-319.

Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.

Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.

Chothia et al., Canonical structures for the hypervariable regions of immunoglobulins, 1987, J. Mol. Biol. 196:901-917.

Chothia, et al., Structural Determinants in the Sequences of Immunoglobulin Variable Domain, J. Mol. Biol., 1998, vol. 278, pp. 457-479.

Chu et al., Immunotherapy with Long-Lived Anti-CD123 x Anti-CD3 Bispecific Antibodies Stimulates Potent T Cell Mediated Killing of Human AML Cell Lines and of CD123+ Cells In Monkeys: A Potential Therapy for Acute Myelogenous Leukemia, Blood 2014, 124:2316.

Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.

Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.

Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.

Conrad, et al., TCR and CD3 Antibody Cross-Reactivity in 44 Species, Cytometry Part A, 2007, vol. 71A, pp. 925-933.

Conrath, et al., Antigen Binding and Solubility Effects upon the Veneering of a Camel VHH in Framework-2 to Mimic a VH, J. Mol. Biol. , 2005, vol. 350, pp. 112-125.

Counterman et al., "Volumes of Individual Amino Acid Residues in Gas-Phase Peptide Ions.", J. Am. Chem. Soc., 1999, 121 (16), pp. 4031-4039.

Cuesta, et al., Multivalent antibodies: when design surpasses evolution, Trends in Biotechnology, 2010, vol. 28, No. 7, pp. 355-362, doi:10.1016/j.tibtech.2010.03.007.

d'Argouges, et al., Combination of rituximab with blinatumomab (MT103/MEDI-538), a T-cell engaging CD19-/CD3-bispecific antibody, for highly efficient lysis of human B lymphoma cells, Leukemia Research, 2009, vol. 33, pp. 465-473.

Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.

Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.

Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.

De Groot et al., De-Immunization Of Therapeutic Proteins By T-Cell Epitope Modification, 2005, Dev. In Biologicals, 2005, 122:171-194.

De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.

Del Nagro et al., A critical role for complement C3d and the B cell coreceptor (CD19/CD21) complex in the initiation of inflammatory arthritis., J Immunol. Oct. 15, 2005;175(8):5379-89.

Demarest et al., Antibody therapeutics, antibody engineering, and the merits of protein stability, Current Opinin in Drug Discovery & Development, 2008 11(5): 675-587, Sep. 11, 2008.

Deyev, et al., Multivalency: the hallmark of antibodies used for optimization of tumor targeting by design, BioEssays, 2008, vol. 30, pp. 904-918.

DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.

DiGiandomenico et al., A multifunctional bispecific antibody protects against Pseudomonas aeruginosa., Sci Transl Med. Nov. 12, 2014;6(262):262ra155. doi: 10.1126/scitranslmed.3009655.

Dixon, et al., Activation of Human T Lymphocytes by Crosslinking of Anti-CD3 Monoclonal Antibodies, Journal of Leukocyte Biology, 1989, vol. 46, pp. 214-220.

Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.

Doronina , Development of potent monoclonal antibody auristatin conjugates for cancer therapy, 2003, Nat Biotechnol 21(7):778-784.

Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.

Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.

Dubowchik et al., Receptor-mediated and enzyme-dependent targeting of cytotoxic anticancer drugs, 1999, Pharm. Therapeutics 83:67-123.

Ducry et al., Antibody-drug conjugates: linking cytotoxic payloads to monoclonal antibodies, 2010, Bioconjugate Chem. 21:5-13.

Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.

Duke, et al., Measurement of apoptosis and other forms of cell death, 2004, Curr protocols immunol. 3.17.1-3.17.16.

DukSin et al., Relationship of the structure and biological activity of the natural homologues of tunicamycin, 1982, J. Biol. Chem. 257:3105.

Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.

Edge et al., Deglycosylation of glycoproteins by trifluoromethanesulfonic acid, 1981, Anal. Biochem. 118:131.

Elliott, et al., Antiparallel Conformation of Knob and Hole Aglycosylated Half-Antibody Homodimers Is Mediated by a CH2—CH3 Hydrophobic Interaction, Journal of Molecular Biology, 2014, vol. 426, Issue 9, pp. 1947-1957.

Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.

Feldmann et al., Retargeting of T Cells to Prostate Stem Cell Antigen Expressing Tumor Cells: Comparison of Different Antibody Formats, Dec. 28, 2010.

Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.

(56) References Cited

OTHER PUBLICATIONS

Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7), pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$,1978, Biochem. Biophys. Res. Commun. 80(4):849-57.
Francois, et al., Construction of a Bispecific Antibody Reacting with the α- and ß-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate.".
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3ɛ Subunits within a T Cell Receptor Complex Lies in Close Proximity to the Cß FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010;588:27-32.
Gunasekaran et al., Enhancing Antibody Fc Heterodimer Formation through Electrostatic Steering Effects, Journal of Biological Cheministry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$ and $V_H$ Segments in the Preferential Reassociation of Immunoglobulin Subunits, Molecular Immunology, 1986, vol. 23, No. 5, pp. 503-510.
HAwkins et al, Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H$3) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.

(56) References Cited

OTHER PUBLICATIONS

Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, $5^{th}$ Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.
Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.
Kipriyanov, et al., Bispecific CD3 x CD19 Diabody for T Cell-Mediated Lysis of Malignant Human B Cells, Int. J. Cancer, 1998. vol. 77, pp. 763-772.
Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications.", Immunopharmacol Immunotoxicol. 2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.
Labrijn, et al., Efficient generation of stable bispecific IgG1 by controlled Fab-arm exchange, www.pnas.org/cgi/doi/10.1073/pnas.1220145110 & Supporting Information.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Lazar Declaration, Dec. 27, 2010, pp. 1-4.
Lewis, et al., Generation of bispecific IgG antibodies by structure-based design of an orthogonal Fab interface, Nature Biotechnology, 2014, doi:10.1038/nbt.2797 & Supplemental Information.
Li, et al., Construction and characterization of a humanized anti-human CD3 monoclonal antibody 12F6 with effective immunoregulation functions, Immunology, 2005, vol. 116, pp. 487-498.
Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.
Ling, et al., Interspecies Scaling of Therapeutic Monoclonal Antibodies: Initial Look, J Clin Pharmacol, 2009, vol. 49, pp. 1382-1402, doi: 10.1177/0091270009337134.
Link, et al., Production and Characterization of a Bispecific IgG Capable of Inducing T-Cell-Mediated Lysis of Malignant B Cells, Blood, 1993, vol. 81, No. 12, pp. 3343-3349.
Linke, et al., Catumaxomab, Clinical development and future directions, mAbs, 2010, vol. 2, Issue 2, pp. 129-136.
Little, et al., Letter to the Editor, "Flawed TandAb production," Molecular Immunology, 2007, vol. 44, p. 3083.
Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.
Liu et al., Eradication of large colon tumor xenografts by targeted delivery of maytansinoids, 1996 Proc. Natl. Acad. Sci. USA 93:8618-8623.
Liu, et al., Crystallization of a Deglycosylated T Cell Receptor (TCR) Complexed with an Anti-TCR Fab Fragment, The Journal of Biological Chemistry, 1996, vol. 271, No. 52, p. 33639-33646.
Lode et al., Targeted therapy with a novel enediyene antibiotic calicheamicins $o^i_1$ effectively suppress growth and dissemination of liver metastases in a syngeneic model of murine neuroblastoma, 1998, Cancer Res. 58:2928.
Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.
Lu, et al., A Fully Human Recombinant IgG-like Bispecific Antibody to Both the Epidermal Growth Factor Receptor and the

(56) References Cited

OTHER PUBLICATIONS

Insulin-like Growth Factor Receptor for Enhanced Antitumor Activity, The Journal of Biological Chemistry, 2005, vol. 280, No. 20, p. 19665-19672.
Lu, et al., Di-diabody: a novel tetravalent bispecific antibody molecule by design, Journal of Immunological Methods, 2003, vol. 279, pp. 219-232.
Lu, et al., Fab-scFv fusion protein: an efficient approach to production of bispecific antibody fragments, Journal of Immunological Methods, 2002, vol. 267, pp. 213-226.
Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.
Lutterbuese, et al., T cell-engaging BiTE antibodies specific for EGFR potently eliminate KRAS-and BRAF-mutated colorectal cancer cells, PNAS Early Edition, 2010, www.pnas.org/cgi/doi/10.1073/pnas.1000976107 & Supporting Information.
Ma, et al., Expression and Characterization of a Divalent Chimeric Anti-Human CD3 Single Chain Antibody, Scand.J.Immunol, 1996, vol. 43, pp. 134-139.
Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.
Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.
Mack, et al., A small bispecific antibody construct expressed as a functional single-chain molecule with high tumor cell cytotoxicity, Proc. Natl. Acad. Sci. USA, 1995, vol. 92, pp. 7021-7025.
Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.
MacroGenics Factsheet, Dual Affinity Re-Targeting ("DART") Platform, 2010.
Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.
Mandler et al., Modifications in synthesis strategy improve the yield and efficacy of geldanamycin-herceptin immunoconjugates, 2002, Bioconjugate Chem. 13:786-791).
Mandler et al., Synthesis and evaluation of antiproliferative activity of a geldanaymcin-herceptin™ immunoconjugates, 2000, Bioorganic & Med. Chem. Letters 10:1025-1028.
Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.
Mandy, et al., Recombination of Univalent Subunits Derived from Rabbit Antibody, The Journal of Biological Chemistry, 1961, vol. 236, No. 12, pp. 3221-3226.
Marks et al., By-passing immunization: building high affinity human antibodies by chain shuffling, 1992, Biotechnology 10:779-783.
Martin, et al., Generation of the Germline Peripheral B Cell Repertoire: VH81X-λ B Cells Are Unable to Complete All Developmental Programs, J. Immunol., 1998, vol. 160, pp. 3748-3758.
Martinez, et al., Characterization of a novel modification on IgG2 light chain: Evidence for the presence of O-linked mannosylation, J. Chromatogr. A, 2007, vol. 1156 pp. 183-187.
Marvin, Bispecific antibodies for dual-modality cancer therapy: killing two signaling cascades with one stone, Curr Opin Drug Discov Devel, 2006, vol. 9(2), pp. 184-193.
Marvin, et al., Recombinant approaches to IgG-like bispecific antibodies, Acta Pharmacologica Sinica, 2005, vol. 26 (6), pp. 649-658.
Mateo et al, Humanization of a mouse nonoclonal antibody that blocks the epidermal growth factor receptor: recovery of antagonistic activity, 1997, Immunotechnology, 3(1):71-81.
McPhee, Engineering human immunodeficiency virus 1 protease heterodimers as macromolecular inhibitors of viral maturation, Proc. Natl. Acad. Sci. USA, 1996, vol. 93, p. 11477-11481.
Meijer, et al., Isolation of Human Antibody Repertoires with Preservation of the Natural Heavy and Light Chain Pairing, J. Mol. Biol., 2006, vol. 358, pp. 764-772.
Merchant, et al., An efficient route to human bispecific IgG, Nature Biotechnology, 1998, vol. 16, pp. 677-681.
Mertens, Nico, "Tribodies: Fab-scFv fusion proteins as a platform to create multi-functional pharmaceuticals.", SpringerLink2011, 135-149.
Metz, et al., Bispecific antibody derivatives with restricted binding functionalities that are activated by proteolytic processing, Protein Engineering, Design & Selection, 2012, vol. 25, No. 10, pp. 571-580.
Metz, et al., Bispecific digoxigenin-binding antibodies for targeted payload delivery, PNAS, 2011, vol. 108, No. 20, pp. 8194-8199.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.
Miller et al., Stability engineering of scFvs for the development of bispecific and multivalent antibodies, PEDS, 2010, vol. 23, No. 7, pp. 549-557 & Supplementary Data.
Miller, biogen idec Stability Engineering and Production of IgG-like Bispecifc Antibodies, AAPS National Biotechnology Conference, Jun. 24 to Jun. 27, 2007.
Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".
Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Modjtahedi et al, Phase I trial and tumour localization of the anti-EGFR monoclonal antibody ICR62 in head and neck or lung cancer, 1996, Br J Cancer, 73(2):228-35.
Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.
Modjtahedi et al., Antitumor activity of combinations of antibodies directed against different epitopes on the extracellular domain of the human EGF receptor, 1993, J. Cell Biophys. 1993, 22(1-3):129-46.
Modjtahedi et al., The human EGF receptor as a target for cancer therapy: six new rat mAbs against the receptor on the breast carcinoma MDA-MB 468, 1993, Br J Cancer. 67(2):247-53.
Mølhøj, et al., CD19-/CD3-bispecific antibody of the BiTE class is far superior to tandem diabody with respect to redirected tumor cell lysis, Molecular Immunology 2007, vol. 44, pp. 1935-1943.
Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.

(56) References Cited

OTHER PUBLICATIONS

Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.
Moore, et al., Application of dual affinity retargeting molecules to achieve optimal redirected T-cell killing of B-cell lymphoma, Blood, 2011, vol. 117, No. 17, pp. 4542-4551.
Moretti et al., BEAT® the bispecific challenge: a novel and efficient platform for the expression of bispecific IgGs. BMC Proceedings 2013 7(Suppl 6):O9.
Morrison, et al., News and Views: Two heads are better than one, Nature Biotechnology, 2007, vol. 25, No. 11, pp. 1233-1234.
Mosmann, 1983, Rapid colorimetric assay for cellular growth and survival: application to proliferation and cytotoxicity assays, J. Immunol. Methods 65:55-63.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Muramatsu et al., Production and characterization of an active single-chain variable fragment antibody recognizing CD25., Cancer Lett. Jul. 28, 2005;225(2):225-36. Epub Jan. 23, 2005.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-ε) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (−)-dolastatin 10.I X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproine1, 1996, Synthesis 719-725.
Pichler et al., Differences of T-Cell Activation by the Anti-CD3 Antibodies Leu4 and BMA030, Mar. 30, 1987.
Potapov et al., Protein-Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering, 1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.

(56) References Cited

OTHER PUBLICATIONS

Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.

Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.

Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.

Salmeron et al., A conformational epitope expressed upon association of CD3-epsilon with either CD3-delta or CD3-gamma is the main target for recognition by anti-CD3 monoclonal antibodies, Nov. 1, 1991.

Sancho et al., CD3-Surface Expression Is Required for CD4-p56lck-mediated Up-regulation of T Cell Antigen Receptor-CD3 Signaling in T Cells, Apr. 16, 1992.

Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.

Schaefer, et al., Immunoglobulin domain crossover as a generic approach for the production of bispecific IgG antibodies, PNAS, 2011, vol. 108, No. 27, pp. 11187-11192.

Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.

Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.

Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.

Schoonjans, et al., Fab Chains As an Efficient Heterodimerization Scaffold for the Production of Recombinant Bispecific and Trispecific Antibody Derivatives, The Journal of Immunology, 2000, vol. 165, pp. 7050-7057.

Schroder et al., The Peptides, vol. pp 76-136, 1965, Academic Press.

Senter et al., Proceedings of the American Association for Cancer Research, 2004, vol. 45, Abstract No. 623.

Senter, Potent antibody drug conjugates for cancer therapy, 2009, Current Opin. Chem. Biol. 13:235.

Sforzini et al., Targeting of saporin to Hodgkin's lymphoma cells by anti-CD30 and anti-CD25 bispecific antibodies., Br J Haematol. Sep. 1998;102(4):1061-8.

Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.

Shan, et al., Characterization of scFv-Ig Constructs Generated from the Anti-CD20 mAb 1F5 Using Linker Peptides of Varying Lengths, J Immunol, 1999, vol. 162, pp. 6589-6595.

Shearman, et al., Construction, Expression and Characterization of Humanized Antibodies Directed Against the Human α/β T Cell Receptor, The Journal of Immunology, 1991, vol. 147, No. 12, pp. 4366-4373.

Shen, et al., Catumaxomab, a rat/murine hybrid trifunctional bispecific monoclonal antibody for the treatment of cancer, Curr Opin Mol Ther, 2008, vol. 10(3), pp. 273-284.

Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.

Shields et al., Lack of fucose on human IgG1 N-linked oligosaccharide improves binding to human FcγRIII and antibody-dependent cellular toxicity, 2002, J Biol Chem 277:26733-26740.

Shier et al., Identification of functional and structural amino-acid residues by parsimonious mutagenesis, 1995, Gene 169:147-155.

Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.

Skehan et al., Identification of functional and structural amino-acid residues by parsimonious mutagenesis, 1990, J. Natl. Cancer Inst. 82(13):1107-12.

Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.

Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.

Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.

Spiess, et al., Bispecific antibodies with natural architecture produced by co-culture of bacteria expressing two distinct half-antibodies, Nature Biotechnology, 2013, doi:10.1038/nbt.2621 & Supplemental Information.

Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.

Stamova, Unexpected recombinations in single chain bispecific anti-CD3-anti-CD33 antibodies can be avoided by a novel linker module, Oct. 29, 2011.

Stanfield, et al., Maturation of Shark Single-domain (IgNAR) Antibodies: Evidence for Induced-fit Binding, J. Mol. Biol., 2007, vol. 367, pp. 358-372.

Stewart, et al., Recombinant CD36 inhibits oxLDL-induced ICAM-1-dependent monocyte adhesion., Mol Immunol. Feb. 2006;43(3):255-67.

Strop, P. et al., Generating Bispecific Human IgG1 and IgG2 Antibodies from Any Antibody Pair, J. Mol. Biol., 2012, doi:10.1016/j.jmb.2012.04.020.

Szymkowski et al., Creating the next generation of protein therapeutics through rational drug design, Current opinion in drug discovery & development, Sep. 1, 2005, p. 590, XP055354917, England.

Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.

Tan et al., "Superhumanized" antibodies: reduction of immunogenic potential by complementarity-determining region grafting with human germline sequences: application to an anti-CD28, 2002, J. Immunol. 169:1119-1125.

Tan, Philip, Presentation at PepTalk, Jan. 25, 2013, "Bi-specific ADAPTIR Molecule Targeting CD86 and Delivering Monomeric IL10 to Inhibit Antigen Presenting Cells".

Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-9258.

Tarcsa et al, Chapter 10 Dual-Variable Domain Immunoglobulin (DVD-Ig™) Technology: A Versatile, Novel Format for the Next Generation of Dual-Targeting Biologies, Bispecific Antibodies 2011, pp. 171-185, 2011.

Teachey, et al., Cytokine release syndrome after blinatumomab treatment related to abnormal macrophage activation and ameliorated with cytokine-directed therapy, Blood, 2013, vol. 121, No. 26, pp. 5154-5157.

Tedgui, et al., Cytokines in atherosclerosis: pathogenic and regulatory pathways., Physiol Rev. Apr. 2006;86(2):515-81.

(56) References Cited

OTHER PUBLICATIONS

Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.

Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.

Thompson, et al., Improved binding of a bivalent single-chain immunotoxin results in increased efficacy for in vivo T-cell depletion, Protein Engineering, 2001, vol. 14, No. 12, pp. 1035-1041.

Thorne, et al., CD36 is a receptor for oxidized high density lipoprotein: implications for the development of atherosclerosis., FEBS Lett. Mar. 20, 2007;581(6):1227-32. Epub Feb. 28, 2007.

Thorpe et al., New coupling agents for the synthesis of immunotoxins containing a hindered disulfide bond with improved stability in Vivo, 1987, Cancer Res. 47:5924-5931.

Thotakura et al., Enzymatic deglycosylating of glycoproteins, 1987, Meth. Enzymol. 138:350.

Thurman et al., Detection of complement activation using monoclonal antibodies against C3d., J Clin Invest. May 2013;123(5):2218-30. doi: 10.1172/JCI65861. Epub Apr. 24, 2013.

Tomlinson et. al., Methods for generating multivalent and bispecific antibody fragments, 2000, Methods Enzymol. 326:461-479.

Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.

Traunecker, et al., Bispecific single chain molecules (Janusins) target cytotoxic lymphocytes on HIV infected cells, The EMBO Journal, 1991, vol. 1, No. 12, pp. 3655-3659.

Tsurushita et al., Humanization of monoclonal antibodies, 2004, Molecular Biology of B Cells 533-545.

Umaña et al., Engineered glycoforms of an antineuro-blastoma IgG1 with optimized antibody-dependent cellular cytotoxic activity, 1999, Nat Biotechnol 17:176-180.

Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.

van Boxel, et al., Some lessons from the systematic production and structural analysis of soluble αβ T-cell receptors, Journal of Immunological Methods, 2009, vol. 350, pp. 14-21.

van Wauwe, et al., OKT3: A Monoclonal Anti-Human T Lymphoctye Antibody with Potent Mitogenic Properties, The Journal of Immunology, 1980, vol. 124, No. 6, pp. 2708-2713.

Verdier, et al., Determination of lymphocyte subsets and cytokine levels in Cynomolgus monkeys, Toxicology, 1995, vol. 105, pp. 81-90.

Verhoeyen et al., Reshaping human antibodies: grafting an antilysozyme activity, 1988, Science, 239:1534-1536.

Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.

Vettermann, et al., Powered by pairing: The surrogate light chain amplifies immunoglobulin heavy chain signaling and pre-selects the antibody repertoire, Seminars in Immunology 18, 2006, pp. 44-55.

Von Kreudenstein et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.

Wang et al., Conserved amino acid networks involved in antibody variable domain interactions, Proteins, 2009, vol. 76, pp. 99-114.

Wang et al., Expression and characterization of recombinant soluble monkey CD3 molecules: mapping the FN18 polymorphic epitope, Molecular Immunology, 2004, vol. 40, pp. 1179-1188.

Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.

Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.

Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.

Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.

Weiner, et al., The Role of T Cell Activation Bispecific Antibody Therapy in Anti-CD3 X Antitumor, Journal of Immunology, 1994, vol. 152, pp. 2385-2392.

Wesolowski, et al., Single domain antibodies: promising experimental and therapeutic tools in infection and immunity, Med Microbiol Immunol, 2009, vol. 198, pp. 157-174.

Whitlow, et al., An improved linker for single-chain Fv with reduced aggregation and enhanced proteolytic stability, Protein Engineering, 1993, vol. 6 , No. 8, pp. 989-995.

Wigginton et al., An immunoglobulin E-reactive chimeric human immunoglobulin G1 anti-idiotype inhibits basophil degranulation through cross-linking of FcεRI with FcγRIIb., Clinical & Experimental Allergy, 38: 313-319.

Wong, et al., The Mechanism of Anti-CD3 Monoclonal Antibodies, Transplantation, 1990, vol. 50, No. 4, pp. 683-689.

Woods, et al., LC-MS characterization and purity assessment of a prototype bispecific antibody, mAbs, 2013, vol. 5, Issue 5, pp. 711-722, http://dx.doi.org/10.4161/mabs.25488.

Woyke et al., In vitro activities and postantifungal effects of the potent dolastation 10 derivative auristatin PHE, 2001, Antimicrob. Agents and Chemother. 45(12):3580-3584.

Wu et al, Molecular construction and optimization of anti-human IL-11 α/β dual variable domain immunoglobulin (DVD-Ig™) molecules, [mAbs 1:4, 339-347; Jul./Aug. 2009]; Landes Bioscience, Apr. 10, 2009.

Wu et al, Simultaneous targeting of multiple disease mediators by a dual-variable-domain immunoglobulin, (DVD-Ig™) molecules, Jul.-Aug. 2009; 339-347, Oct. 14, 2007.

Wu et al., Humanization of a murine monoclonal antibody by simultaneous optimization of framework and CDR residues, 1999, J. Mol. Biol. 294:151-162.

Wu, et al., Multimerization of a chimeric anti-CD20 single-chain Fv-Fc fusion protein is mediated through variable domain exchange, Protein Engineering, 2001, vol. 14, No. 12, pp. 1025-1033.

Wucherpfennig, et al., Structural Biology of the T-cell Receptor: Insights into Receptor Assembly, Ligand Recognition, and Initiation of Signaling, Cold Spring Harb Perspect Biol 2010;2:a005140.

Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.

Xu, et al., Combinatorial surrobody libraries, PNAS, 2008, vol. 105, No. 31, pp. 10756-10761.

Xu, et al., Rapid optimization and prototyping for therapeutic antibody-like molecules, mAbs, 2013, vol. 5, Issue 2, pp. 237-254.

Xu, et al., Surrobodies with Functional Tails, J. Mol. Biol., 2010, vol. 397, pp. 352-360.

Yang et al., Differential in vitro activation of CD8-CD4+ and CD4-CD8+ T lymphocytes by combinations of anti-CD2 and anti-CD3 antibodies, Apr. 1, 1988.

Yelton et al., Affinity maturation of the BR96 anti-carcinoma antibody by codon-based mutagenesis, 1995, J. Immunol. 155:1994-2004.

Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.

(56) References Cited

OTHER PUBLICATIONS

Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.
Zalevsky et al. "Enhanced antibody half-life improves in vivo activity." Nature Biotechnology, vol. 28, No. 2, Feb. 1, 2010, pp. 157-159.
Zamyatnin AA., Amino acid, peptide, and protein volume in solution., Annu Rev Biophys Bioeng. 1984;13:145-65.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.
Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.
Zhu, et al., Remodeling domain interfaces to enhance heterodimer formation, Protein Science, 1997, vol. 6, pp. 781-788.
Zeibig et al., Effect of the oxLDL Binding Protein Fc-CD68 on Plaque Extension and Vulnerability in Atherosclerosis., Circulation Research 108: 695-703, 2011.
Zuo, et al., An efficient route to the production of an IgG-like bispecific antibody, Protein Engineering, 2000, vol. 13, No. 5, pp. 361-367.
Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.
Capizzi et al., Curative chemotherapy for acute myeloid leukemia: the development of high-dose ara-C from the laboratory to bedside., Invest New Drugs. 1996;14(3):249-56.
Giles et al., Intravenous corticosteroids to reduce gemtuzumab ozogamicin infusion reactions. Ann Pharmacother. Sep. 2003;37(9):1182-5.
Duong et al., Targeted treatment of acute myeloid leukemia in older adults: role of gemtuzumab ozogamicin., Clin Interv Aging. 2009;4:197-205. Epub May 14, 2009.
Sun et al., Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.
Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.
Zhang et al., The development of bispecific antibodies and their applications in tumor immune escape., Experimental Hematology & Oncology20176:12.
Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.
Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.
Masarova et al., Immune Checkpoint Approaches in AML and MDS: A Next Frontier?, The Journal of Targeted Therapies in Cancer, Mar. 6, 2017 (Mar. 6, 2017), XP002784099.
Scott et al., Antibody therapy of cancer., Nat Rev Cancer. Mar. 22, 2012;12(4):278-87. doi: 10.1038/nrc3236.
Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.

Merchant et al., Monovalent antibody design and mechanism of action of onartuzumab, a MET antagonist with anti-tumor activity as a therapeutic agent., Proc Natl Acad Sci USA. Aug. 6, 2013;110(32):E2987-96. doi: 10.1073/pnas.1302725110. Epub Jul. 23, 2013.
Fos et al., ICOS ligation recruits the p50alpha PI3K regulatory subunit to the immunological synapse., J Immunol. Aug. 1, 2008;181(3):1969-77.
Sanmamed et al., Agonists of Co-stimulation in Cancer Immunotherapy Directed Against CD137, OX40, GITR, CD27, CD28, and ICOS., Semin Oncol. Aug. 2015;42(4):640-55. doi: 10.1053/j.seminoncol. 2015.05.014. Epub Jun. 11, 2015.
Vieira et al., ICOS-mediated signaling regulates cytokine production by human T cells and provides a unique signal to selectively control the clonal expansion of Th2 helper cells., Eur J Immunol. May 2004;34(5):1282-90.
Madrenas et al., Conversion of CTLA-4 from inhibitor to activator of T cells with a bispecific tandem single-chain Fv ligand., J Immunol. May 15, 2004;172(10):5948-56.
Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09. 006.
Carpenter et al., Activation of human B cells by the agonist CD40 antibody CP-870,893 and augmentation with simultaneous toll-like receptor 9 stimulation., J Transl Med. Nov. 11, 2009;7:93. doi: 10.1186/1479-5876-7-93.
Fan et al., Engagement of the ICOS pathway markedly enhances efficacy of CTLA-4 blockade in cancer immunotherapy., J Exp Med. Apr. 7, 2014;211(4):715-25. doi: 10.1084/jem.20130590. Epub Mar. 31, 2014.
Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.
Uy et al., Preliminary Results of a Phase 1 Study of Flotetuzumab, a CD123 × CD3 Bispecific Dart® Protein, in Patients with Relapsed/Refractory Acute Myeloid Leukemia and Myelodysplastic Syndrome., Blood 2017 130:637.
Vey et al., Interim Results from a Phase 1 First-in-Human study of flotetuzumab, a CD123 – CD3 bispecific DART molecule, in AML/MDS., Annals of Oncology (2017) 28 (suppl_5): v355-v371. 10.1093/annonc/mdx373.
Ravandi et al., Complete Responses in Relapsed/Refractory Acute Myeloid Leukemia (AML) Patients on a Weekly Dosing Schedule of XmAb14045, a CD123 x CD3 T Cell-Engaging Bispecific Antibody: Initial Results of a Phase 1 Study., Blood 2018 132:763; doi: https://doi.org/10.1182/blood-2018-99-119786.
Bacac et al., A Novel Carcinoembryonic Antigen T-Cell Bispecific Antibody (CEA TCB) for the Treatment of Solid Tumors., Clin Cancer Res. Jul. 1, 2016;22(13):3286-97.
Schuster et al., Immunotherapy with the trifunctional anti-CD20 x anti-CD3 antibody FBTA05 (Lymphomun) in paediatric high-risk patients with recurrent CD20-positive B cell malignancies., Br J Haematol. Apr. 2015;169(1):90-102. doi: 10.1111/bjh.13242. Epub Dec. 11, 2014.
Shields et al.; "High Resolution Mapping of the Binding Site on Human IgG 1 for FcγRI, FcγRII, FcγRIII, and FcRn and Design of IgG1 Variants with Improved Binding to the FcγR*", The Journal of Biological Chemistry, 2001, 276(2):6591-6604.
Szymkowski et al;" Anti-CD38—anti-CD3 bispecific antibody in multiple myeloma", Xencor, pp. 1-15. Mar. 28, 2014.
Human Somatostatin R2/SSTR2 Antibody, MAB4224: R&D Systems, https://www.rndsystems.com/products/human-somatostatin-r2-sstr2-antibody-402038_mab4224#product-details, Rev. Feb. 7, 201.
Julg, B. et al "Enhanced Anti-HIV Functional Activity Associated with Gag-Specific CD8 T-Cell Responses." Journal of Virology 84.11 (2010): 5540-5549. Web. Jul. 13, 2020.
Tutt et al., Trispecific F(ab')3 derivatives that use cooperative signaling via the TCR/CD3 complex and CD2 to activate and redirect resting cytotoxic T cells., The Journal of Immunology Jul. 1, 1991, 147 (1)60-69.

(56) References Cited

OTHER PUBLICATIONS

Armour et al., Recombinant human IgG molecules lacking Fc γ receptor I binding and monocyte triggering activities., Eur. J. Immunol. 1999. 29: 2613-2624.
Bogolyubova et al., Cancer immunotherapy based on the blockade of immune checkpoints, Oct. 2015, Medical Immunology (Russia) 17(5):395.
Schanzer et al., "A Novel Glycoengineered Bispecific Antibody Format for Targeted Inhibition of Epidermal Growth Factor Receptor (EGFR) and Insulin-like Growth Factor Receptor Type 1 (IGF-1 R) Demonstrating Unique Molecular Properties", Journal of Biological Chemistry, vol. 289, No. 27, May 19, 2014 (May 19, 2014), pp. 18693-18706.
Volker Baum et al, "Antitumor activities of PSMA x CD3 diabodies by redirected T-cell lysis of prostate cancer cells", Immunotherapy, vol. 5, No. 1, pp. 27-38, Jan. 31, 2013.
Stewart et al., "The role of Fc gamma receptors in the activity of immunomodulatory antibodies for cancer", Journal for Immunotherapy of Cancer, Biomed Central, London, UK, vol. 2, No. 1, Aug. 19, 2014 (Aug. 19, 2014), p. 29.
Moore et al., A robust heterodimeric Fc platform engineered for efficient development of bispecific antibodies of multiple formats., Methods. Feb. 1, 2019;154:38-50. doi: 10.1016/j.ymeth.2018.10. 006. Epub Oct. 23, 2018.
Celine Monnet et al: "Selection of IgG variants with increased FcRn binding using random and directed mutagenesis: impact on effector functions", Frontiers in Immunology, vol. 6, No. 39, Feb. 4, 2015 (Feb. 4, 2015), pp. 1-14, XP055238838, DOI: 10.3389/fimmu.2015. 00039.
Sondermann Peter et al: "Harnessing Fc receptor biology in the design of therapeutic antibodies", Current Opinion in Immunology, Elsevier, Oxford, GB, vol. 40, Mar. 30, 2016 (Mar. 30, 2016), pp. 78-87, XP029551351, ISSN: 0952-7915, DOI: 10.1016/J.COI.2016. 03.005.
Deckert et al., "A Novel Humanized CD38-Targeting Antibody, Demonstrates Potent Antitumor Activity in Models of Multiple Myeloma and Other CD38+ Hematologic Malignancies", Clinical Cancer Research, vol. 20, No. 17, pp. 4574-4583 (Sep. 2014).
De Weers et al., "Daratumumab, a Novel Therapeutic Human CD38 Monoclonal Antibody, Induces Killing of Multiple Myeloma and Other Hematological Tumors", The Journal of Immunology, vol. 186, No. 3, pp. 1840-1848 (Dec. 2010).
Wang et al., Comparison of Biologic Activity of Two Anti-PSA/ Anti-CD3 Bispecific Singlechain Antibodies, National Journal of Androloqy, vol. 13(1), pp. 8-12 (2007).
Wu et al., Fab-based bispecific antibody formats with robust biophysical properties and biological activity. mAbs, 7:3, 470-482, Published online: May 1, 2015.
Holliger et al., Engineered antibody fragments and the rise of single domains., Nature Biotechnology, vol. 23, pp. 1126-1136 (2005).
Reusch U et al Anti-CD3 x anti-epidermal growth factor receptor (EGFR) bispecific antibody redirects T-cell cytolytic activity to EGFRpositive cancers in vitro and in an animal model, Clinical Cancer Research, The American Association for Cancer Research, US, vol. 12, No. 1, Jan. 1, 2006 (Jan. 1, 2006), pp. 183-190.
Roland Kontermann: "Dual targeting strategies with bispecific antibodies", mAbs, vol. 4, No. 2, Mar. 1, 2012 (Mar. 1, 2012), pp. 182-197, XP055566203.
Kontermann Rolande: "Recombinant bispecific antibodies for cancer therapy", ACTA Pharmacologica Sinica, vol. 26, No. 1, Jan. 1, 2005 (Jan. 1, 2005), pp. 1-9, XP002426874.
Steffen Dickopf et al, "Format and geometries matter: Structurebased design defines the functionality of bispecific antibodies", Computational and Structural Biotechnology Journal,vol. 18, May 14, 2020 (May 14, 2020), pp. 1221-1227.
Roda-Navarro Pedro et al, "Understanding the Spatial Topology of Artificial Immunological Synapses Assembled in T Cell-Redirecting Strategies: A Major Issue in Cancer Immunotherapy", Frontiers in Cell and Developmental Biology,vol. 7, Jan. 10, 2020 (Jan. 10, 2020).
Suurs Frans V et al, "A review of bispecific antibodies and antibody constructs in oncology and clinical challenges", Apr. 24, 2019 (Apr. 24, 2019), vol. 201, pp. 103-119.
Chen Shixue et al, "Immunoglobulin Gamma-Like Therapeutic Bispecific Antibody Formats for Tumor Therapy", US Feb. 11, 2019 (Feb. 11, 2019), vol. 2019, p. 1-13,.
Thomas Van Blarcom et al, "Productive common light chain libraries yield diverse panels of high affinity bispecific antibodies", MABS,vol. 10, No. 2, Dec. 14, 2017 (Dec. 14, 2017), p. 256-268.
Hedvat Michael et al, "697—Tumor-targeted CD28 costimulatory bispecific antibodies enhance T cell activation in solid tumors", Journal for Immunotherapy of Cancer,vol. 8, No. Suppl 3, Nov. 1, 2020 (Nov. 1, 2020), p. A739-A739.
Correnti Colin E et al: "Simultaneous multiple interaction T-cell engaging (SMITE) bispecific antibodies overcome bispecific T-cell engager (BiTE) resistance via CD28 co-stimulation", Leukemia, Nature Publishing Group UK, London, vol. 32, No. 5, Jan. 31, 2018 (Jan. 31, 2018), pp. 1239-1243 &.
Correnti, Colin E. et al: Supplemental Methods Simultaneous multiple interaction T-cell engaging (SMITE) bispecific antibodies overcome bispecific T-cell engager (BiTE) resistance via CD28 co-stimulation, Leukemia, Jan. 31, 2018 (Jan. 31, 2018), pp. 1-7, XP055656259, DOI: 10.1038/s41375-018-0014-3 Retrieved from the Internet: URL:doi:10.1038/s41375-018-0014—[retrieved on Jan. 9, 2020].
Brinkmann et al: The making of bispecific antibodies., MABS, vol. 9, No. 2, Jan. 10, 2017 (Jan. 10, 2017), pp. 182-212.
Moore Gregory L et al: "Abstract 1880: PDL1-targeted CD28 costimulatory bispecific antibodies enhance T cell activation in solid tumors", Cancer Research, Jul. 1, 2021 (Jul. 1, 2021), XP055881520, Retrieved from the Internet: URL:https://cancerres.aacrjournals.org/content/81/13_Supplement/1880.
Moore Gregory L et al: "PDL1-targeted CD28 costimulatory bispecific antibodies enhance T cell activation in solid tumors", Jul. 1, 2021 (Jul. 1, 2021), XP055881523, Retrieved from the Internet: URL:https://investors.xencor.com/static-files/5adc4e21-6760-4eec-b7b3-f2b6765bddc3.
Tolcher Anthony W. et al: "A phase 1 study of anti-TGF[beta] receptor type-II monoclonal antibody LY3022859 in patients with advanced solid tumors", Cancer Chemotherapy and Pharmacology, Springer Verlag, Berlin, DE, vol. 79, No. 4, Mar. 9, 2017 (Mar. 9, 2017), pp. 673-680, XP036196406.
Moore Gregory et al: "714-PD1 x TGF[beta]R2 bispecifics selectively block TGF[beta]R2 on PDI-positive T cells, promote T cell activation, and elicit an anti-tumor response in solid tumors", Journal for Immunotherapy of Cancer, vol. 8, No. Suppl 3, Nov. 9, 2020 (Nov. 9, 2020), pp. A756-A756.
Moore Gregory et al: "Abstract #714 "PD1 x TGF[beta]R2 bispecifics selectively block TGF[beta]R2 on PDI-positive T cells, promote T cell activation, and elicit an anti-tumor response in solid tumors, Journal for immunotherapy of cancer, Nov. 9, 2020 (Nov. 9, 2020), pp. A756-A756, XP055884418, London DOI: 10.1136/jitc-2020-SITC2020.0714 Retrieved from the Internet: URL:https://investors.xencor.com/static-files/abba11c4-fe9a-4152a209-88c0d55c3906 [retrieved on Jan. 27, 2022].
Brinkmann et al., Cloning and expression of the recombinant FAb fragment of monoclonal antibody K1 that reacts with mesothelin present on mesotheliomas and ovarian cancers., Int J Cancer. May 16, 1997;71(4):638-44.
Stadler et al., Elimination of large tumors in mice by mRNAencoded bispecific antibodies., Nat Med. Jul. 2017;23(7):815-817. doi: 10.1038/nm.4356. Epub Jun. 1, 20172.
Zhu et al., Targeting CLDN18.2 by CD3 Bispecific and ADC Modalities for the Treatments of Gastric and Pancreatic Cancer., Scientific Reports vol. 9, Article No. 8420 (2019).

\* cited by examiner

Figure 1A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 1B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 1C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 1D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |
| T366S/L368A/Y407V/S354C | T366W/Y349C |

Figure 1E

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T/N203D/K274Q/R355Q/N384S/K392N/V397M/Q419E/K447_ | |
| N208D/Q295E/N384D/Q418E/N421D | |
| N208D/Q295E/Q418E/N421D | |
| Q196K/I199T/P217R/P228R/N276K | |
| Q196K/I199T/N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 2

| Variant constant region | Substitutions |
|---|---|
| pI-ISO(-) | I199T/N203D/K274Q/R355Q/N384S/K392N/N397M/Q419E/K447_ |
| pI_ISO(-)-Fc only | K274Q/R355Q/N384S/K392N/V397M/Q419E/K447_ |
| pI_(-)_isosteric_A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 3

Ablation Variants
G236R
S239G
S239K
S239Q
S239R
V266D
S267K
S267R
H268K
E269R
299R
299K
K322A
A327G
A327L
A327N
A327Q
L328E
L328R
P329A
P329H
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figure 4

| Heavy Chain 1 (-) e.g. Fab-Fc | Heavy Chain 2 (+) e.g. scFv-Fc or Fab-scFv-Fc |
|---|---|
|  | C220S |
| Heterodimer variants L368D/K370S | Heterodimer variants S364K/E357Q |
| Isosteric pI substitutions N208D/Q295E/N384D/Q418E/N421D |  |
| FcKO E233P/L234V/L235A/G236_/S267K | FcKO E233P/L234V/L235A/G236_/S267K |
| ±M428L/N434S | ±M428L/N434S |

Figure 5

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | 6 |
| Whitlow linker | GSTSGSGKPGSGEGSTKG | 18 | +1 | 7 |
| 6paxA_1 (+A) | IRPRAIGGSKPRVA | 14 | +4 | 8 |
| +B | GKGGSGKGGSGKGGS | 15 | +3 | 9 |
| +C | GGKGSGGKGSGGKGS | 15 | +3 | 10 |
| +D | GGGKSGGGKSGGGKS | 15 | +3 | 11 |
| +E | GKGKSGKGKSGKGKS | 15 | +6 | 12 |
| +F | GGGKSGGKGSGKGGS | 15 | +3 | 13 |
| +G | GKPGSGKPGSGKPGS | 15 | +3 | 14 |
| +H | GKPGSGKPGSGKPGSGKPGS | 20 | +4 | 1 |
| +I | GKGKSGKGKSGKGKSGKGKS | 20 | +8 | 16 |

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | 17 |
| 3hsc_2 (-A) | STAGDTHLGGEDFD | 14 | -4 | 18 |
| -B | GEGGSGEGGSGEGGS | 15 | -3 | 19 |
| -C | GGEGSGGEGSGGEGS | 15 | -3 | 20 |
| -D | GGGESGGGESGGGES | 15 | -3 | 21 |
| -E | GEGESGEGESGEGES | 15 | -6 | 22 |
| -F | GGGESGGEGSGEGGS | 15 | -3 | 23 |
| -G | GEGESGEGESGEGESGEGES | 20 | -8 | 24 |

Additional scFv Linkers

| | |
|---|---|
| GGGGSGGGGSGGGGS | SEQ ID NO:25 |
| GGGGSGGGGSGGGGSGGGGS | SEQ ID NO:26 |
| GSTSGSGKPGSGEGSTKG | SEQ ID NO:27 |
| PRGASKSGSASQTGSAPGS | SEQ ID NO:28 |
| GTAAAGAGAAGGAAAGAAG | SEQ ID NO:29 |
| GTSGSSGSGSGGSGSGGG | SEQ ID NO:30 |
| GKPGSGKPGSGKPGSGKPGS | SEQ ID NO:15 |

Figure 6

Useful domain linkers

| Name | Sequence | SEQ ID NO: |
|---|---|---|
| (GGGGS)$_1$ or GGGGS | GGGGS | 5 |
| (GGGGS)$_2$ | GGGGSGGGGS | 31 |
| (GGGGS)$_3$ | GGGGSGGGGSGGGGS | 32 |
| (GGGGS)$_4$ | GGGGSGGGGSGGGGSGGGGS | 33 |
| (GGGGS)$_5$ | GGGGSGGGGSGGGGSGGGGSGGGGS | 34 |
| (GGGGS)$_6$ | GGGGSGGGGSGGGGSGGGGSGGGGSGGGGS | 35 |
| (GGGGS)$_7$ | GGGGSGGGGSGGGGSGGGGSGGGGSGGGGSGGGGS | 36 |
| (GGGGA)$_1$ or GGGGA | GGGGA | 37 |
| (GGGGA)$_2$ | GGGGAGGGGA | 38 |
| (GGGGA)$_3$ | GGGGAGGGGAGGGGA | 39 |
| (GGGGA)$_4$ | GGGGAGGGGAGGGGAGGGGA | 40 |
| (GGGGA)$_5$ | GGGGAGGGGAGGGGAGGGGAGGGGA | 41 |
| (GGGGA)$_6$ | GGGGAGGGGAGGGGAGGGGAGGGGAGGGGA | 42 |
| (GGGGA)$_7$ | GGGGAGGGGAGGGGAGGGGAGGGGAGGGGAGGGGA | 43 |
| 30AA-linker | DPALVHQRPAPPGGGGSGGGGSGGGGSGGG | 44 |
| (GKPGS)$_1$ or GKPGS | GKPGS | 45 |
| (GKPGS)$_5$ | GKPGSGKPGSGKPGSGKPGSGKPGS | 46 |
| (GKPGS)$_6$ | GKPGSGKPGSGKPGSGKPGSGKPGSGKPGS | 47 |
| (GGGES)$_1$ or GGGES | GGGES | 48 |
| "half hinge" | KTHTCPPCP | 49 |
| "full hinge C220S variant" | EPKSSDKTHTCPPCP | 50 |
| "flex half hinge" | GGGGSGGGGSKTHTCPPCP | 51 |
| "charged half hinge1" | GKPGSGKPGSKTHTCPPCP | 52 |
| "charged half hinge2" | GKPGSKTHTCPPCP | 53 |

Figure 7A

1 + 1 Fab-scFv-Fc Backbone 1

>Fab-Fc Side (SEQ ID NO: 54)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK >scFv-Fc Side (SEQ ID NO: 55)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

1 + 1 Fab-scFv-Fc Backbone 2

>Fab-Fc Side (SEQ ID NO: 56)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK >scFv-Fc Side (SEQ ID NO: 57)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVKLTCLVK
GFYPSDIAVEWESNGQPENNYKTTPPVLDSDGSFFLYSKLTVDKSRWQQGNVFSCSVMHEALHNHYTQKSLSLSPGK

1 + 1 Fab-scFv-Fc Backbone 3

>Fab-Fc Side (SEQ ID NO: 58)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCEVSGFYPSDIAVEWESDGQPENNYKTTPPVLDSDGSFFLYSKLTVDKSRWEQGDVFSCS
VMHEALHNHYTQKSLSLSPGK >scFv-Fc Side (SEQ ID NO: 59)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVKLTCLVK
GFYPSDIAVEWESNGQPENNYKTTPPVLDSDGSFFLYSKLTVDKSRWQQGNVFSCSVMHEALHNHYTQKSLSLSPGK

1 + 1 Fab-scFv-Fc Backbone 4

>Fab-Fc Side (SEQ ID NO: 60)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTENEVSLTCLVKGFYPSDIAVEWESDGQPENNYKTTPPVLDSDGSFFLYSKLEVDKSRWEQGDVFSCS
VMHEALHNHYTQKSLSLSPGK

Figure 7B

>scFv-Fc Side (SEQ ID NO: 61)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSKGSFFLYSKLTVDKSRWQQGNVFSCSVMHEALHNHYTQKSLSLSPGK

1 + 1 Fab-scFv-Fc Backbone 5

>Fab-Fc Side (SEQ ID NO: 62)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSRDELTKNQVSLTCDVSGFYPSDIAVEWESDGQPENNYKTTPPVLDSDGSFFLYSKLTVDKSRWEQGDVFSCS
VMHEALHNHYTQKSLSLSPGK >scFv-Fc Side (SEQ ID NO: 63)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSRDQLTKNQVKLTCLVK
GFYPSDIAVEWESNGQPENNYKTTPPVLDSDGSFFLYSKLTVDKSRWQQGNVFSCSVMHEALHNHYTQKSLSLSPGK

1 + 1 Fab-scFv-Fc Backbone 6

>Fab-Fc Side (SEQ ID NO: 64)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYASTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK >scFv-Fc Side (SEQ ID NO: 65)
EPKSSDKTHTCPPCPAPPVAGPSVFLFPPKPKDTLMISRTPEVTCVVVDVKHEDPEVKFNWYVDGVEVHNAKTKPRE
EQYASTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

1 + 1 Fab-scFv-Fc Backbone 7

>Fab-Fc Side (SEQ ID NO: 66)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYSSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK >scFv-Fc Side (SEQ ID NO: 67)
EPKSSDKTHTCPPCPAPPVAGPSVFLFPPKPKDTLMISRTPEVTCVVVDVKHEDPEVKFNWYVDGVEVHNAKTKPRE
EQYSSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 7C

1 + 1 Fab-scFv-Fc Backbone 8

>Fab-Fc Side (SEQ ID NO: 68)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRVESKYGPPCPPCPAPEFLGGPSVFLFPPKPKDTLMISRTPEVTCVVVDVSQEDPEVQ
FNWYVDGVEVHNAKTKPREEEFNSTYRVVSVLTVLHQDWLNGKEYKCKVSNKGLPSSIEKTISKAKGQPREPQVYTL
PPSQEEMTKNQVSLTCDVSGFYPSDIAVEWESDGQPENNYKTTPPVLDSDGSFFLYSRLTVDKSRWEEGDVFSCSVM
HEALHNHYTQKSLSLSLGK >scFv-Fc Side (SEQ ID NO: 69)
ESKYGPPCPPCPAPEFLGGPSVFLFPPKPKDTLMISRTPEVTCVVVDVSQEDPEVQFNWYVDGVEVHNAKTKPREEQ
FNSTYRVVSVLTVLHQDWLNGKEYKCKVSNKGLPSSIEKTISKAKGQPREPQVYTLPPSQEQMTKNQVKLTCLVKGF
YPSDIAVEWESNGQPENNYKTTPPVLDSDGSFFLYSRLTVDKSRWQEGNVFSCSVMHEALHNHYTQKSLSLSLGK

1 + 1 Fab-scFv-Fc Backbone 9

>Fab-Fc Side (SEQ ID NO: 70)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPPCPAPPVAGPSVFLFPPKPKDTLMISRTPEVTCVVVDVSHEDPEVQF
NWYVDGVEVHNAKTKPREEEFNSTFRVVSVLTVVHQDWLNGKEYKCKVSNKGLPAPIEKTISKTKGQPREPQVYTLP
PSREEMTKNQVSLTCDVSGFYPSDIAVEWESDGQPENNYKTTPPMLDSDGSFFLYSKLTVDKSRWEQGDVFSCSVMH
EALHNHYTQKSLSLSPGK >scFv-Fc Side (SEQ ID NO: 71)
ERKCCVECPPCPAPPVAGPSVFLFPPKPKDTLMISRTPEVTCVVVDVSHEDPEVQFNWYVDGVEVHNAKTKPREEQF
NSTFRVVSVLTVVHQDWLNGKEYKCKVSNKGLPAPIEKTISKTKGQPREPQVYTLPPSREQMTKNQVKLTCLVKGFY
PSDIAVEWESNGQPENNYKTTPPMLDSDGSFFLYSKLTVDKSRWQQGNVFSCSVMHEALHNHYTQKSLSLSPGK

1 + 1 Fab-scFv-Fc Backbone 10

>Fab-Fc Side (SEQ ID NO: 72)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPPCPAPPVAGPSVFLFPPKPKDTLMISRTPEVTCVVVDVKHEDPEVQF
NWYVDGVEVHNAKTKPREEEFNSTFRVVSVLTVVHQDWLNGKEYKCKVSNKGLPAPIEKTISKTKGQPREPQVYTLP
PSREEMTKNQVSLTCDVSGFYPSDIAVEWESDGQPENNYKTTPPMLDSDGSFFLYSKLTVDKSRWEQGDVFSCSVMH
EALHNHYTQKSLSLSPGK >scFv-Fc Side (SEQ ID NO: 73)
ERKCCVECPPCPAPPVAGPSVFLFPPKPKDTLMISRTPEVTCVVVDVKHEDPEVQFNWYVDGVEVHNAKTKPREEQF
NSTFRVVSVLTVVHQDWLNGKEYKCKVSNKGLPAPIEKTISKTKGQPREPQVYTLPPSREQMTKNQVKLTCLVKGFY
PSDIAVEWESNGQPENNYKTTPPMLDSDGSFFLYSKLTVDKSRWQQGNVFSCSVMHEALHNHYTQKSLSLSPGK

1 + 1 Fab-scFv-Fc Backbone 11

>Fab-Fc Side (SEQ ID NO: 74)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VLHEALHSHYTQKSLSLSPGK

Figure 7D

>scFv-Fc Side (SEQ ID NO: 75)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVLHEALHSHYTQKSLSLSPGK <u>1 + 1 Fab-scFv-Fc Backbone 12</u>

>Fab-Fc Side (SEQ ID NO: 76)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREEMTKNQVSLTCDVAGFYPSDIAVEWESNGQPENNYKTTPPVLDSDGSFFLYSKLTVDKSRWQQGNVFSCS
VMHEALHNHYTQKSLSLSPGK

>scFv-Fc Side (SEQ ID NO: 77)
ERKSSDKTHTCPPRPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 8A

2 + 1 Fab2-scFv-Fc Backbone 1

>Fab-Fc Side (SEQ ID NO: 78)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK >Fab-scFv-Fc Side (SEQ ID NO: 79)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

2 + 1 Fab2-scFv-Fc Backbone 2

>Fab-Fc Side (SEQ ID NO: 80)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK >Fab-scFv-Fc Side (SEQ ID NO: 81)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVKLTCLVKGFYPSDIAVEWESNG
QPENNYKTTPPVLDSDGSFFLYSKLTVDKSRWQQGNVFSCSVMHEALHNHYTQKSLSLSPGK

2 + 1 Fab2-scFv-Fc Backbone 3

>Fab-Fc Side (SEQ ID NO: 82)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCEVSGFYPSDIAVEWESDGQPENNYKTTPPVLDSDGSFFLYSKLTVDKSRWEQGDVFSCS
VMHEALHNHYTQKSLSLSPGK >Fab-scFv-Fc Side (SEQ ID NO: 83)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVKLTCLVKGFYPSDIAVEWESNG
QPENNYKTTPPVLDSDGSFFLYSKLTVDKSRWQQGNVFSCSVMHEALHNHYTQKSLSLSPGK

2 + 1 Fab2-scFv-Fc Backbone 4

>Fab-Fc Side (SEQ ID NO: 84)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTENEVSLTCLVKGFYPSDIAVEWESDGQPENNYKTTPPVLDSDGSFFLYSKLEVDKSRWEQGDVFSCS
VMHEALHNHYTQKSLSLSPGK

Figure 8B

>Fab-scFv-Fc Side (SEQ ID NO: 85)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSKGSFFLYSKLTVDKSRWQQGNVFSCSVMHEALHNHYTQKSLSLSPGK

2 + 1 Fab2-scFv-Fc Backbone 5

>Fab-Fc Side (SEQ ID NO: 86)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSRDELTKNQVSLTCDVSGFYPSDIAVEWESDGQPENNYKTTPPVLDSDGSFFLYSKLTVDKSRWEQGDVFSCS
VMHEALHNHYTQKSLSLSPGK

>Fab-scFv-Fc Side (SEQ ID NO: 87)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSRDQLTKNQVKLTCLVKGFYPSDIAVEWESNG
QPENNYKTTPPVLDSDGSFFLYSKLTVDKSRWQQGNVFSCSVMHEALHNHYTQKSLSLSPGK

2 + 1 Fab2-scFv-Fc Backbone 6

>Fab-Fc Side (SEQ ID NO: 88)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYASTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

>Fab-scFv-Fc Side (SEQ ID NO: 89)
APPVAGPSVFLFPPKPKDTLMISRTPEVTCVVVDVKHEDPEVKFNWYVDGVEVHNAKTKPREEQYASTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

2 + 1 Fab2-scFv-Fc Backbone 7

>Fab-Fc Side (SEQ ID NO: 90)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYSSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

>Fab-scFv-Fc Side (SEQ ID NO: 91)
APPVAGPSVFLFPPKPKDTLMISRTPEVTCVVVDVKHEDPEVKFNWYVDGVEVHNAKTKPREEQYSSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Figure 8C

2 + 1 Fab2-scFv-Fc Backbone 8

>Fab-Fc Side (SEQ ID NO: 92)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VLHEALHSHYTQKSLSLSPGK >Fab-scFv-Fc Side (SEQ ID NO: 93)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVLHEALHSHYTQKSLSLSPGK

2 + 1 Fab2-scFv-Fc Backbone 9

>Fab-Fc Side (SEQ ID NO: 94)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREEMTKNQVSLTCDVAGFYPSDIAVEWESNGQPENNYKTTPPVLDSDGSFFLYSKLTVDKSRWQQGNVFSCS
VMHEALHNHYTQKSLSLSPGK >Fab-scFv-Fc Side (SEQ ID NO: 95)
APPVAGPSVFLFPPKPKDTLMISRTPEVTCVVVDVKHEDPEVKFKWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Figure 9

Constant Light Domain – Kappa (SEQ ID NO: 96)
RTVAAPSVFIFPPSDEQLKSGTASVVCLLNNFYPREAKVQWKVDNALQSGNSQESVTEQDSKDSTYSLSSTLTLSKADYEKHKVYACEVTHQG
LSSPVTKSFNRGEC

Constant Light Domain – Lambda (SEQ ID NO: 97)
GQPKAAPSVTLFPPSSEELQANKATLVCLISDFYPGAVTVAWKADSSPVKAGVETTTPSKQSNNKYAASSYLSLTPE
QWKSHRSYSCQVTHEGSTVEKTVAPTECS

Figure 10A

CD3 High – [anti-CD3]_H1.30_L1.47_scFv

| | Sequence | SEQ ID NO: |
|---|---|---|
| scFv (VHVL) | EVQLVESGGGLVQPGGSLRLSCAASGFTFSTYAMNWVRQAPGKGLEWVGRIRSK YNNYATYYADSVKGRFTISRDDSKNTLYLQMNSLRAEDTAVYYCVRHGNFGDSY VSWFAYWGQGTLVTVSS/GKPGSGKPGSGKPGSGKPGS/QAVVTQEPSLTVSPG GTVTLTCGSSTGAVTTSNYANWVQQKPGKSPRGLIGGTNKRAPGVPARFSGSLL GGKAALTISGAQPEDEADYYCALWYSNHWVFGGGTKLTVL | 98 |
| scFv (VLVH) | QAVVTQEPSLTVSPGGTVTLTCGSSTGAVTTSNYANWVQQKPGKSPRGLIGGTN KRAPGVPARFSGSLLGGKAALTISGAQPEDEADYYCALWYSNHWVFGGGTKLTV L/GKPGSGKPGSGKPGSGKPGS/EVQLVESGGGLVQPGGSLRLSCAASGFTFST YAMNWVRQAPGKGLEWVGRIRSKYNNYATYYADSVKGRFTISRDDSKNTLYLQM NSLRAEDTAVYYCVRHGNFGDSYVSWFAYWGQGTLVTVSS | 99 |
| Variable Heavy (vh) Domain | EVQLVESGGGLVQPGGSLRLSCAASGFTFSTYAMNWVRQAPGKGLEWVGRIRSK YNNYATYYADSVKGRFTISRDDSKNTLYLQMNSLRAEDTAVYYCVRHGNFGDSY VSWFAYWGQGTLVTVSS | 100 |
| vhCDR1 | TYAMN | 101 |
| vhCDR2 | RIRSKYNNYATYYADSVKG | 102 |
| vhCDR3 | HGNFGDSYVSWFAY | 103 |
| Variable Light (vl) Domain | QAVVTQEPSLTVSPGGTVTLTCGSSTGAVTTSNYANWVQQKPGKSPRGLIGGTN KRAPGVPARFSGSLLGGKAALTISGAQPEDEADYYCALWYSNHWVFGGGTKLTV L | 104 |
| vlCDR1 | GSSTGAVTTSNYAN | 105 |
| vlCDR2 | GTNKRAP | 106 |
| vlCDR3 | ALWYSNHWV | 107 |
| Linker | GKPGSGKPGSGKPGSGKPGS | 108 |

Figure 10B

CD3 High-Int #1 – [anti-CD3]_H1.32_L1.47_scFv

| | Sequence | SEQ ID NO: |
|---|---|---|
| scFv (VHVL) | EVQLVESGGGLVQPGGSLRLSCAASGFTFSTYAMNWVRQAPGKGLEWVGRIRSK ANNYATYYADSVKGRFTISRDDSKNTLYLQMNSLRAEDTAVYYCVRHGNFGDSY VSWFAYWGQGTLVTVSS/GKPGSGKPGSGKPGSGKPGS/QAVVTQEPSLTVSPG GTVTLTCGSSTGAVTTSNYANWVQQKPGKSPRGLIGGTNKRAPGVPARFSGSLL GGKAALTISGAQPEDEADYYCALWYSNHWVFGGGTKLTVL | 109 |
| scFv (VLVH) | QAVVTQEPSLTVSPGGTVTLTCGSSTGAVTTSNYANWVQQKPGKSPRGLIGGTN KRAPGVPARFSGSLLGGKAALTISGAQPEDEADYYCALWYSNHWVFGGGTKLTV L/GKPGSGKPGSGKPGSGKPGS/EVQLVESGGGLVQPGGSLRLSCAASGFTFST YAMNWVRQAPGKGLEWVGRIRSKANNYATYYADSVKGRFTISRDDSKNTLYLQM NSLRAEDTAVYYCVRHGNFGDSYVSWFAYWGQGTLVTVSS | 110 |
| Variable Heavy (vh) Domain | EVQLVESGGGLVQPGGSLRLSCAASGFTFSTYAMNWVRQAPGKGLEWVGRIRSK ANNYATYYADSVKGRFTISRDDSKNTLYLQMNSLRAEDTAVYYCVRHGNFGDSY VSWFAYWGQGTLVTVSS | 111 |
| vhCDR1 | TYAMN | 112 |
| vhCDR2 | RIRSKANNYATYYADSVKG | 113 |
| vhCDR3 | HGNFGDSYVSWFAY | 114 |
| Variable Light (vl) Domain | QAVVTQEPSLTVSPGGTVTLTCGSSTGAVTTSNYANWVQQKPGKSPRGLIGGTN KRAPGVPARFSGSLLGGKAALTISGAQPEDEADYYCALWYSNHWVFGGGTKLTV L | 115 |
| vlCDR1 | GSSTGAVTTSNYAN | 116 |
| vlCDR2 | GTNKRAP | 117 |
| vlCDR3 | ALWYSNHWV | 118 |
| Linker | GKPGSGKPGSGKPGSGKPGS | 119 |

Figure 10C

CD3 High-Int #2 – [anti-CD3]_H1.89_L1.47_scFv

| | Sequence | SEQ ID NO: |
|---|---|---|
| scFv (VHVL) | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 120 |
| scFv (VLVH) | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS | 121 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS | 122 |
| vhCDR1 | TYAMN | 123 |
| vhCDR2 | RIRSKYNNYATYYADSVKG | 124 |
| vhCDR3 | HGNFGDEYVSWFAY | 125 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 126 |
| vlCDR1 | GSSTGAVTTSNYAN | 127 |
| vlCDR2 | GTNKRAP | 128 |
| vlCDR3 | ALWYSNHWV | 129 |
| Linker | GKPGSGKPGSGKPGSGKPGS | 130 |

Figure 10D

CD3 High-Int #3 – [anti-CD3]_H1.90_L1.47_scFv

|  | Sequence | SEQ ID NO: |
|---|---|---|
| scFv (VHVL) | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 131 |
| scFv (VLVH) | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | 132 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | 133 |
| vhCDR1 | TYAMN | 134 |
| vhCDR2 | RIRSKYNNYATYYADSVKG | 135 |
| vhCDR3 | HGNFGDPYVSWFAY | 136 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 137 |
| vlCDR1 | GSSTGAVTTSNYAN | 138 |
| vlCDR2 | GTNKRAP | 139 |
| vlCDR3 | ALWYSNHWV | 140 |
| Linker | GKPGSGKPGSGKPGSGKPGS | 141 |

Figure 10E

CD3-Intermediate – [anti-CD3]_H1.33_L1.47_scFv

| | Sequence | SEQ ID NO: |
|---|---|---|
| scFv (VHVL) | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 142 |
| scFv (VLVH) | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS | 143 |
| Variable Heavy (vh) Domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS | 144 |
| vhCDR1 | TYAMN | 145 |
| vhCDR2 | RIRSKYNNYATYYADSVKG | 146 |
| vhCDR3 | HGNFGDSYVSWFDY | 147 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 148 |
| vlCDR1 | GSSTGAVTTSNYAN | 149 |
| vlCDR2 | GTNKRAP | 150 |
| vlCDR3 | ALWYSNHWV | 151 |
| Linker | GKPGSGKPGSGKPGSGKPGS | 152 |

Figure 10F

CD3 Low – [anti-CD3] H1.31_L1.47_scFv

| | Sequence | SEQ ID NO: |
|---|---|---|
| scFv (VHVL) | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 153 |
| scFv (VLVH) | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | 154 |
| Variable Heavy (vh) Domain | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | 155 |
| vhCDR1 | TYAMS | 156 |
| vhCDR2 | RIRSKYNNYATYYADSVKG | 157 |
| vhCDR3 | HGNFGDSYVSWFAY | 158 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 159 |
| vlCDR1 | GSSTGAVTTSNYAN | 160 |
| vlCDR2 | GTNKRAP | 161 |
| vlCDR3 | ALWYSNHWV | 162 |
| Linker | GKPGSGKPGSGKPGSGKPGS | 163 |

Figure 11

Human CLDN6 sequence
>sp|P56747
MASAGMQILGVVLTLLGWVNGLVSCALPMWKVTAFIGNSIVVAQVVWEGLWMSCVVQSTGQMQCKVYDSLLALPQDL
QAARALCVIALLVALFGLLVYLAGAKCTTCVEEKDSKARLVLTSGIVFVISGVLTLIPVCWTAHAIIRDFYNPLVAE
AQKRELGASLYLGWAASGLLLLGGGLLCCTCPSGGSQGPSHYMARYSTSAPAISRGPSEYPTKNYV (SEQ ID
NO: 164)

Human CLDN6 sequence, N-terminal extracellular domain
>sp|P56747|29-81
MWKVTAFIGNSIVVAQVVWEGLWMSCVVQSTGQMQCKVYDSLLALPQDLQAAR (SEQ ID NO: 165)

Human CLDN6 sequence, C-terminal extracellular domain
>sp|P56747|138-160
WTAHAIIRDFYNPLVAEAQKREL (SEQ ID NO: 166)

Mouse CLDN6 sequence
>sp|Q9Z262
MASTGLQILGIVLTLLGWVNALVSCALPMWKVTAFIGNSIVVAQMVWEGLWMSCVVQSTGQMQCKVYDSLLALPQDL
QAARALCVVTLLIVLLGLLVYLAGAKCTTCVEDRNSKSRLVLISGIIFVISGVLTLIPVCWTAHSIIQDFYNPLVAD
AQKRELGASLYLGWAASGLLLLGGGLLCCACSSGGTQGPRHYMACYSTSVPHSRGPSEYPTKNYV (SEQ ID NO:
167)

Mouse CLDN6 sequence, N-terminal extracellular domain
>sp|Q9Z262|29-81
MWKVTAFIGNSIVVAQMVWEGLWMSCVVQSTGQMQCKVYDSLLALPQDLQAAR (SEQ ID NO: 168)

Mouse CLDN6 sequence, C-terminal extracellular domain
>sp|Q9Z262|138-163
WTAHSIIQDFYNPLVADAQKRELGAS (SEQ ID NO: 169)

Macaca fascicularis CLDN6 sequence (predicted)
>tr|G7Q0B0
MASAGMQILGVVLTLLGWVNGLVSCALPMWKVTAFIGNSIVVAQVVWEGLWMSCVVQSTGQMQCKVYDSLLALPQDL
QAARALCVIALLVALFGLLVYLAGAKCTTCVEEKDSKARLVLTSGIVFVISGVLTLIPVCWTAHAIIRDFYNPLVAE
AQKRELGASLYLGWAASGLLLLGGGLLCCTCPSGGSRGPSHYMARYSTSAPAISRGPSEYPTKNYV (SEQ ID
NO: 170)

Macaca fascicularis CLDN6 sequence, N-terminal extracellular domain (predicted)
>tr|G7Q0B0|29-81
MWKVTAFIGNSIVVAQVVWEGLWMSCVVQSTGQMQCKVYDSLLALPQDLQAAR (SEQ ID NO: 171)

Macaca fascicularis CLDN6 sequence, C-terminal extracellular domain (predicted)
>tr|G7Q0B0|138-160
WTAHAIIRDFYNPLVAEAQKREL (SEQ ID NO: 172)

Figure 12

≡ EC loop

```
cldn6    MASAGMQILGVVLTLLGWVNGLVSCALPMWKVTAFIGNSIVVAQVVWEGLWMSCVVQSTG  60
cldn9    MASTGLELLGMTLAVLGWLGTLVSCALPMWKVTAFIGNSIVVAQVVWEGLWMSCVVQSTG  60
         ***.*.:::**:.*::*:. ****:*************************** cldn6    QMQCKVYDSLLALPQDLQAARALCVIALLVALFGLLVYLAGAKCTTCVEEKDSKARLVLT  120
cldn9    QMQCKVYDSLLALPQDLQAARALCVIALLLALLGLLVAITGAQCTTCVEDEGAKARIVLT  120
         *************************** :.**  :.***::. :*:*** cldn6    SGIVFVISGVLTLIPVCWTAHAIIRDFYNPLVAEAQKRELGASLYLGWAASGLLLLGGGL  180
cldn9    AGVILLLAGILVLIPVCWTAHAIIRDFYNPLVAEAQKRELGASLYLGWAAAALLMLGGGL  180
         :*:::.:.:*:*.**************.* **********:.:***** cldn6    LCCTCPSGGSQGPSHYMARYSTSAPAISRGPSEYPTKNYV        220
cldn9    LCCTCPPPQVERPRGPRLGYSIPSR---SGASGLDKRDYV        217
         ******  : *    **  :     * *   .::**
```

Figure 13 mC6-30[CLDN6]

|  | sequence | SEQ ID NO: |
|---|---|---|
| Variable heavy (vh) domain | EVQLQQSGPELVKPGASVKISCKTSGYTFTEYTMHWVKQSPGKSLEW IGGIDPNNGNTHYNQKFKGKATLTVDKSSSTAYMELRSLTSEDSAVY YCARIYYFGRLYFDFWGAGTTVTVSS | 175 |
| vhCDR1 | EYTMH | 176 |
| vhCDR2 | GIDPNNGNTHYNQKFKG | 177 |
| vhCDR3 | IYYFGRLYFDF | 178 |
| Variable light (vl) domain | DIQMTQSSSSFSVSLGDRVTITCKASEDIYNRLAWYQQKPGNVPRLL ISGATSLETGVPSRFSGSGSGKDYTLSITSLQTEDVTTYYCQQYWSS PLTFGGGTKLEIK | 179 |
| vlCDR1 | KASEDIYNRLA | 180 |
| vlCDR2 | GATSLET | 181 |
| vlCDR3 | QQYWSSPLT | 182 |

>XENP34243 mC6-30
mC6-30 Heavy Chain
EVQLVQSGAEVKKPGESLRISCKTSGYTFTEYTMHWVRQMPGKSLEWMGGIDSNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 183)

mC6-30 Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 184)

Figure 14

C6-30[CLDN6]_H1

| | sequence | SEQ ID NO: |
|---|---|---|
| Variable heavy (vh) domain | QVQLVQSGAEVKKPGASVKVSCKTSGYTFTEYTMHWVRQAPGQSLEW MGGIDPNNGNTHYNQKFQGRVTITVDKSASTAYMELSSLRSEDTAVY YCARIYYFGRLYFDFWGAGTLVTVSS | 185 |
| vhCDR1 | EYTMH | 186 |
| vhCDR2 | GIDPNNGNTHYNQKFQG | 187 |
| vhCDR3 | IYYFGRLYFDF | 188 |

C6-30[CLDN6]_H2

| | sequence | SEQ ID NO: |
|---|---|---|
| Variable heavy (vh) domain | EVQLVQSGAEVKKPGESLRISCKTSGYTFTEYTMHWVRQMPGKSLEW MGGIDPNNGNTHYNQKFQGHVTISVDKSISTAYLQWSSLKASDTAMY YCARIYYFGRLYFDFWGAGTLVTVSS | 189 |
| vhCDR1 | EYTMH | 190 |
| vhCDR2 | GIDPNNGNTHYNQKFQG | 191 |
| vhCDR3 | IYYFGRLYFDF | 192 |

C6-30[CLDN6]_L1

| | sequence | SEQ ID NO: |
|---|---|---|
| Variable light (vl) domain | DIQMTQSPSSLSASVGDRVTITCQASEDIYNRLAWYQQKPGKVPKLL ISGATSLETGVPSRFSGSGSGKDYTFTISSLQPEDIATYYCQQYWSS PLTFGGGTKVEIK | 193 |
| vlCDR1 | QASEDIYNRLA | 194 |
| vlCDR2 | GATSLET | 195 |
| vlCDR3 | QQYWSSPLT | 196 |

C6-30[CLDN6]_L2

| | sequence | SEQ ID NO: |
|---|---|---|
| Variable light (vl) domain | DIQMTQSPDSLAVSLGERATINCKASEDIYNRLAWYQQKPGQVPKLL ISGATSLETGVPSRFSGSGSGKDYTLTISSLQAEDVAVYYCQQYWSS PLTFGGGTKVEIK | 197 |
| vlCDR1 | KASEDIYNRLA | 198 |
| vlCDR2 | GATSLET | 199 |
| vlCDR3 | QQYWSSPLT | 200 |

Figure 15A

C6-30{CLDN6}_H1.1

| | sequence | SEQ ID NO: |
|---|---|---|
| Variable heavy (vh) domain | QVQLVQSGAEVKKPGASVKVSCKTSGYTFTEYTMHWVRQAPGQSLEW MGGISPNNGNTHYNQKFQGRVTITVDKSASTAYMELSSLRSEDTAVY YCARIYYFGRLYFDFWGAGTLVTVSS | 201 |
| vhCDR1 | EYTMH | 202 |
| vhCDR2 | GISPNNGNTHYNQKFQG | 203 |
| vhCDR3 | IYYFGRLYFDF | 204 |

C6-30{CLDN6}_H1.2

| | sequence | SEQ ID NO: |
|---|---|---|
| Variable heavy (vh) domain | QVQLVQSGAEVKKPGASVKVSCKTSGYTFTEYTMHWVRQAPGQSLEW MGGINPNNGNTHYNQKFQGRVTITVDKSASTAYMELSSLRSEDTAVY YCARIYYFGRLYFDFWGAGTLVTVSS | 205 |
| vhCDR1 | EYTMH | 206 |
| vhCDR2 | GINPNNGNTHYNQKFQG | 207 |
| vhCDR3 | IYYFGRLYFDF | 208 |

C6-30{CLDN6}_H1.3

| | sequence | SEQ ID NO: |
|---|---|---|
| Variable heavy (vh) domain | QVQLVQSGAEVKKPGASVKVSCKTSGYTFTEYTMHWVRQAPGQSLEW MGGIDSNNGNTHYNQKFQGRVTITVDKSASTAYMELSSLRSEDTAVY YCARIYYFGRLYFDFWGAGTLVTVSS | 209 |
| vhCDR1 | EYTMH | 210 |
| vhCDR2 | GIDSNNGNTHYNQKFQG | 211 |
| vhCDR3 | IYYFGRLYFDF | 212 |

C6-30{CLDN6}_H1.4

| | sequence | SEQ ID NO: |
|---|---|---|
| Variable heavy (vh) domain | QVQLVQSGAEVKKPGASVKVSCKTSGYTFTEYTMHWVRQAPGQSLEW MGGIDANNGNTHYNQKFQGRVTITVDKSASTAYMELSSLRSEDTAVY YCARIYYFGRLYFDFWGAGTLVTVSS | 213 |
| vhCDR1 | EYTMH | 214 |
| vhCDR2 | GIDANNGNTHYNQKFQG | 215 |
| vhCDR3 | IYYFGRLYFDF | 216 |

C6-30{CLDN6}_H1.5

| | sequence | SEQ ID NO: |
|---|---|---|
| Variable heavy (vh) domain | QVQLVQSGAEVKKPGASVKVSCKTSGYTFTEYTMHWVRQAPGQSLEW MGGIDPQNGNTHYNQKFQGRVTITVDKSASTAYMELSSLRSEDTAVY YCARIYYFGRLYFDFWGAGTLVTVSS | 217 |
| vhCDR1 | EYTMH | 218 |
| vhCDR2 | GIDPQNGNTHYNQKFQG | 219 |
| vhCDR3 | IYYFGRLYFDF | 220 |

Figure 15B

C6-30[CLDN6]_H1.6

|  | sequence | SEQ ID NO: |
|---|---|---|
| Variable heavy (vh) domain | QVQLVQSGAEVKKPGASVKVSCKTSGYTFTEYTMHWVRQAPGQSLEW MGGIDPNSGNTHYNQKFQGRVTITVDKSASTAYMELSSLRSEDTAVY YCARIYYFGRLYFDFWGAGTLVTVSS | 221 |
| vhCDR1 | EYTMH | 222 |
| vhCDR2 | GIDPNSGNTHYNQKFQG | 223 |
| vhCDR3 | IYYFGRLYFDF | 224 |

C6-30[CLDN6]_H1.7

|  | sequence | SEQ ID NO: |
|---|---|---|
| Variable heavy (vh) domain | QVQLVQSGAEVKKPGASVKVSCKTSGYTFTEYTMHWVRQAPGQSLEW MGGIDPNQGNTHYNQKFQGRVTITVDKSASTAYMELSSLRSEDTAVY YCARIYYFGRLYFDFWGAGTLVTVSS | 225 |
| vhCDR1 | EYTMH | 226 |
| vhCDR2 | GIDPNQGNTHYNQKFQG | 227 |
| vhCDR3 | IYYFGRLYFDF | 228 |

C6-30[CLDN6]_H1.8

|  | sequence | SEQ ID NO: |
|---|---|---|
| Variable heavy (vh) domain | QVQLVQSGAEVKKPGASVKVSCKTSGYTFTEYTMHWVRQAPGQSLEW MGGIDPNNDNTHYNQKFQGRVTITVDKSASTAYMELSSLRSEDTAVY YCARIYYFGRLYFDFWGAGTLVTVSS | 229 |
| vhCDR1 | EYTMH | 230 |
| vhCDR2 | GIDPNNDNTHYNQKFQG | 231 |
| vhCDR3 | IYYFGRLYFDF | 232 |

C6-30[CLDN6]_H1.9

|  | sequence | SEQ ID NO: |
|---|---|---|
| Variable heavy (vh) domain | QVQLVQSGAEVKKPGASVKVSCKTSGYTFTEYTMHWVRQAPGQSLEW MGGIDPNNANTHYNQKFQGRVTITVDKSASTAYMELSSLRSEDTAVY YCARIYYFGRLYFDFWGAGTLVTVSS | 233 |
| vhCDR1 | EYTMH | 234 |
| vhCDR2 | GIDPNNANTHYNQKFQG | 235 |
| vhCDR3 | IYYFGRLYFDF | 236 |

C6-30[CLDN6]_H1.19

|  | sequence | SEQ ID NO: |
|---|---|---|
| Variable heavy (vh) domain | QVQLVQSGAEVKKPGASVKVSCKTSGYTFTEYTMHWVRQAPGQSLEW MGGIDPNNGNTHYNQKFQGRVTITVDKSASTAYMELSSLRSEDTATY YCARIYYFGRLYFDFWGAGTLVTVSS | 237 |
| vhCDR1 | EYTMH | 238 |
| vhCDR2 | GIDPNNGNTHYNQKFQG | 239 |
| vhCDR3 | IYYFGRLYFDF | 240 |

Figure 15C

C6-30[CLDN6]_H1.22

|  | sequence | SEQ ID NO: |
|---|---|---|
| Variable heavy (vh) domain | QVQLVQSGAEVKKPGASVKVSCKTSGYTFTEYTMHWVRQAPGQSLEW MGGIDPNNGNTHYNQKFQGRVTITVDKSASTAYMELSSLRSEDTAVY YCARILYFGRLYFDFWGAGTLVTVSS | 241 |
| vhCDR1 | EYTMH | 242 |
| vhCDR2 | GIDPNNGNTHYNQKFQG | 243 |
| vhCDR3 | ILYFGRLYFDF | 244 |

C6-30[CLDN6]_H1.24

|  | sequence | SEQ ID NO: |
|---|---|---|
| Variable heavy (vh) domain | QVQLVQSGAEVKKPGASVKVSCKTSGYTFTEYTMHWVRQAPGQSLEW MGGIDPNNGNTHYNQKFQGRVTITVDKSASTAYMELSSLRSEDTAVY YCARIYYLGRLYFDFWGAGTLVTVSS | 245 |
| vhCDR1 | EYTMH | 246 |
| vhCDR2 | GIDPNNGNTHYNQKFQG | 247 |
| vhCDR3 | IYYLGRLYFDF | 248 |

C6-30[CLDN6]_H2.1

|  | sequence | SEQ ID NO: |
|---|---|---|
| Variable heavy (vh) domain | EVQLVQSGAEVKKPGESLRISCKTSGYTFTEYTMHWVRQMPGKSLEW MGGISPNNGNTHYNQKFQGHVTISVDKSISTAYLQWSSLKASDTAMY YCARIYYFGRLYFDFWGAGTLVTVSS | 249 |
| vhCDR1 | EYTMH | 250 |
| vhCDR2 | GISPNNGNTHYNQKFQG | 251 |
| vhCDR3 | IYYFGRLYFDF | 252 |

C6-30[CLDN6]_H2.2

|  | sequence | SEQ ID NO: |
|---|---|---|
| Variable heavy (vh) domain | EVQLVQSGAEVKKPGESLRISCKTSGYTFTEYTMHWVRQMPGKSLEW MGGITPNNGNTHYNQKFQGHVTISVDKSISTAYLQWSSLKASDTAMY YCARIYYFGRLYFDFWGAGTLVTVSS | 253 |
| vhCDR1 | EYTMH | 254 |
| vhCDR2 | GITPNNGNTHYNQKFQG | 255 |
| vhCDR3 | IYYFGRLYFDF | 256 |

C6-30[CLDN6]_H2.3

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDSNNGNTHYNQKFQGHVTISVDKSISTAYLQWSSLKASDTAMY YCARIYYFGRLYFDFWGAGTLVTVSS | 257 |
| vhCDR1 | EYTMH | 258 |
| vhCDR2 | GIDSNNGNTHYNQKFQG | 259 |
| vhCDR3 | IYYFGRLYFDF | 260 |

Figure 15D

C6-30[CLDN6]_H2.4

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDGNNGNTHYNQKFQGHVTISVDKSISTAYLQWSSLKASDTAMY YCARIYYFGRLYFDFWGAGTLVTVSS | 261 |
| vhCDR1 | EYTMH | 262 |
| vhCDR2 | GIDGNNGNTHYNQKFQG | 263 |
| vhCDR3 | IYYFGRLYFDF | 264 |

C6-30[CLDN6]_H2.5

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDPQNGNTHYNQKFQGHVTISVDKSISTAYLQWSSLKASDTAMY YCARIYYFGRLYFDFWGAGTLVTVSS | 265 |
| vhCDR1 | EYTMH | 266 |
| vhCDR2 | GIDPQNGNTHYNQKFQG | 267 |
| vhCDR3 | IYYFGRLYFDF | 268 |

C6-30[CLDN6]_H2.6

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDPNDGNTHYNQKFQGHVTISVDKSISTAYLQWSSLKASDTAMY YCARIYYFGRLYFDFWGAGTLVTVSS | 269 |
| vhCDR1 | EYTMH | 270 |
| vhCDR2 | GIDPNDGNTHYNQKFQG | 271 |
| vhCDR3 | IYYFGRLYFDF | 272 |

C6-30[CLDN6]_H2.7

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDPNQGNTHYNQKFQGHVTISVDKSISTAYLQWSSLKASDTAMY YCARIYYFGRLYFDFWGAGTLVTVSS | 273 |
| vhCDR1 | EYTMH | 274 |
| vhCDR2 | GIDPNQGNTHYNQKFQG | 275 |
| vhCDR3 | IYYFGRLYFDF | 276 |

C6-30[CLDN6]_H2.8

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDPNNDNTHYNQKFQGHVTISVDKSISTAYLQWSSLKASDTAMY YCARIYYFGRLYFDFWGAGTLVTVSS | 277 |
| vhCDR1 | EYTMH | 278 |
| vhCDR2 | GIDPNNDNTHYNQKFQG | 279 |
| vhCDR3 | IYYFGRLYFDF | 280 |

Figure 15E

C6-30[CLDN6]_H2.9

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDPNNANTHYNQKFQGHVTISVDKSISTAYLQWSSLKASDTAMY YCARIYYFGRLYFDFWGAGTLVTVSS | 281 |
| vhCDR1 | EYTMH | 282 |
| vhCDR2 | GIDPNNANTHYNQKFQG | 283 |
| vhCDR3 | IYYFGRLYFDF | 284 |

C6-30[CLDN6]_H2.11

|  | sequence | SEQ ID NO: |
|---|---|---|
| Variable heavy (vh) domain | EVQLVQSGAEVKKPGESLRISCKTSGYSFTEYTMHWVRQMPGKSLEW MGGIDPNNGNTHYNQKFQGHVTISVDKSISTAYLQWSSLKASDTAMY YCARIYYFGRLYFDFWGAGTLVTVSS | 285 |
| vhCDR1 | EYTMH | 286 |
| vhCDR2 | GIDPNNGNTHYNQKFQG | 287 |
| vhCDR3 | IYYFGRLYFDF | 288 |

C6-30[CLDN6]_H2.12

|  | sequence | SEQ ID NO: |
|---|---|---|
| Variable heavy (vh) domain | EVQLVQSGAEVKKPGESLRISCKTSGYDFTEYTMHWVRQMPGKSLEW MGGIDPNNGNTHYNQKFQGHVTISVDKSISTAYLQWSSLKASDTAMY YCARIYYFGRLYFDFWGAGTLVTVSS | 289 |
| vhCDR1 | EYTMH | 290 |
| vhCDR2 | GIDPNNGNTHYNQKFQG | 291 |
| vhCDR3 | IYYFGRLYFDF | 292 |

C6-30[CLDN6]_H2.71

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDLNNGNTHYNQKFQGHVTISVDKSISTAYLQWSSLKASDTAMY YCARIYYFGRLYFDFWGAGTLVTVSS | 293 |
| vhCDR1 | EYTMH | 294 |
| vhCDR2 | GIDLNNGNTHYNQKFQG | 295 |
| vhCDR3 | IYYFGRLYFDF | 296 |

C6-30[CLDN6]_H2.75

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDPHNGNTHYNQKFQGHVTISVDKSISTAYLQWSSLKASDTAMY YCARIYYFGRLYFDFWGAGTLVTVSS | 297 |
| vhCDR1 | EYTMH | 298 |
| vhCDR2 | GIDPHNGNTHYNQKFQG | 299 |
| vhCDR3 | IYYFGRLYFDF | 300 |

Figure 15F

C6-30[CLDN6]_H2.90

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDPNNLNTHYNQKFQGHVTISVDKSISTAYLQWSSLKASDTAMY YCARIYYFGRLYFDFWGAGTLVTVSS | 301 |
| vhCDR1 | EYTMH | 302 |
| vhCDR2 | GIDPNNLNTHYNQKFQG | 303 |
| vhCDR3 | IYYFGRLYFDF | 304 |

C6-30[CLDN6]_H2.91

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDPNNFNTHYNQKFQGHVTISVDKSISTAYLQWSSLKASDTAMY YCARIYYFGRLYFDFWGAGTLVTVSS | 305 |
| vhCDR1 | EYTMH | 306 |
| vhCDR2 | GIDPNNFNTHYNQKFQG | 307 |
| vhCDR3 | IYYFGRLYFDF | 308 |

C6-30[CLDN6]_H2.118

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDPNNGNTHYNQKKQGHVTISVDKSISTAYLQWSSLKASDTAMY YCARIYYFGRLYFDFWGAGTLVTVSS | 309 |
| vhCDR1 | EYTMH | 310 |
| vhCDR2 | GIDPNNGNTHYNQKKQG | 311 |
| vhCDR3 | IYYFGRLYFDF | 312 |

C6-30[CLDN6]_H2.119

|  | sequence | SEQ ID NO: |
|---|---|---|
| Variable heavy (vh) domain | EVQLVQSGAEVKKPGESLRISCKTSGYTFTEYTMHWVRQMPGKSLEW MGGIDPNNGNTHYNQKFEGHVTISVDKSISTAYLQWSSLKASDTAMY YCARIYYFGRLYFDFWGAGTLVTVSS | 313 |
| vhCDR1 | EYTMH | 314 |
| vhCDR2 | GIDPNNGNTHYNQKFEG | 315 |
| vhCDR3 | IYYFGRLYFDF | 316 |

C6-30[CLDN6]_L1.1

|  | sequence | SEQ ID NO: |
|---|---|---|
| Variable light (vl) domain | DIQMTQSPSSLSASVGDRVTITCQASQDIYNRLAWYQQKPGKVPKLL ISGATSLETGVPSRFSGSGSGKDYTFTISSLQPEDIATYYCQQYWSS PLTFGGGTKVEIK | 317 |
| vlCDR1 | QASQDIYNRLA | 318 |
| vlCDR2 | GATSLET | 319 |
| vlCDR3 | QQYWSSPLT | 320 |

Figure 15G

C6-30[CLDN6]_L1.4

|  | sequence | SEQ ID NO: |
|---|---|---|
| Variable light (vl) domain | DIQMTQSPSSLSASVGDRVTITCQASEDVYNRLAWYQQKPGKVPKLLISGATSLETGVPSRFSGSGSGKDYTFTISSLQPEDIATYYCQQYWSSPLTFGGGTKVEIK | 321 |
| vlCDR1 | QASEDVYNRLA | 322 |
| vlCDR2 | GATSLET | 323 |
| vlCDR3 | QQYWSSPLT | 324 |

C6-30[CLDN6]_L1.7

|  | sequence | SEQ ID NO: |
|---|---|---|
| Variable light (vl) domain | DIQMTQSPSSLSASVGDRVTITCQASEDIYSRLAWYQQKPGKVPKLLISGATSLETGVPSRFSGSGSGKDYTFTISSLQPEDIATYYCQQYWSSPLTFGGGTKVEIK | 325 |
| vlCDR1 | QASEDIYSRLA | 326 |
| vlCDR2 | GATSLET | 327 |
| vlCDR3 | QQYWSSPLT | 328 |

C6-30[CLDN6]_L1.16

|  | sequence | SEQ ID NO: |
|---|---|---|
| Variable light (vl) domain | DIQMTQSPSSLSASVGDRVTITCQASEDIYNRLAWYQQKPGKVPKLLISAATSLETGVPSRFSGSGSGKDYTFTISSLQPEDIATYYCQQYWSSPLTFGGGTKVEIK | 329 |
| vlCDR1 | QASEDIYNRLA | 330 |
| vlCDR2 | AATSLET | 331 |
| vlCDR3 | QQYWSSPLT | 332 |

C6-30[CLDN6]_L1.18

|  | sequence | SEQ ID NO: |
|---|---|---|
| Variable light (vl) domain | DIQMTQSPSSLSASVGDRVTITCQASEDIYNRLAWYQQKPGKVPKLLISGTTSLETGVPSRFSGSGSGKDYTFTISSLQPEDIATYYCQQYWSSPLTFGGGTKVEIK | 333 |
| vlCDR1 | QASEDIYNRLA | 334 |
| vlCDR2 | GTTSLET | 335 |
| vlCDR3 | QQYWSSPLT | 336 |

Figure 15H

C6-30[CLDN6] L1.19

| | sequence | SEQ ID NO: |
|---|---|---|
| Variable light (vl) domain | DIQMTQSPSSLSASVGDRVTITCQASEDIYNRLAWYQQKPGKVPKLLISGASSLETGVPSRFSGSGSGKDYTFTISSLQPEDIATYYCQQYWSSPLTFGGGTKVEIK | 337 |
| vlCDR1 | QASEDIYNRLA | 338 |
| vlCDR2 | GASSLET | 339 |
| vlCDR3 | QQYWSSPLT | 340 |

C6-30[CLDN6] L1.21

| | sequence | SEQ ID NO: |
|---|---|---|
| Variable light (vl) domain | DIQMTQSPSSLSASVGDRVTITCQASEDIYNRLAWYQQKPGKVPKLLISGATNLETGVPSRFSGSGSGKDYTFTISSLQPEDIATYYCQQYWSSPLTFGGGTKVEIK | 341 |
| vlCDR1 | QASEDIYNRLA | 342 |
| vlCDR2 | GATNLET | 343 |
| vlCDR3 | QQYWSSPLT | 344 |

C6-30[CLDN6] L1.22

| | sequence | SEQ ID NO: |
|---|---|---|
| Variable light (vl) domain | DIQMTQSPSSLSASVGDRVTITCQASEDIYNRLAWYQQKPGKVPKLLISGATQLETGVPSRFSGSGSGKDYTFTISSLQPEDIATYYCQQYWSSPLTFGGGTKVEIK | 345 |
| vlCDR1 | QASEDIYNRLA | 346 |
| vlCDR2 | GATQLET | 347 |
| vlCDR3 | QQYWSSPLT | 348 |

C6-30[CLDN6] L1.23

| | sequence | SEQ ID NO: |
|---|---|---|
| Variable light (vl) domain | DIQMTQSPSSLSASVGDRVTITCQASEDIYNRLAWYQQKPGKVPKLLISGATSRETGVPSRFSGSGSGKDYTFTISSLQPEDIATYYCQQYWSSPLTFGGGTKVEIK | 349 |
| vlCDR1 | QASEDIYNRLA | 350 |
| vlCDR2 | GATSRET | 351 |
| vlCDR3 | QQYWSSPLT | 352 |

Figure 15I

C6-30[CLDN6] L1.27

|  | sequence | SEQ ID NO: |
|---|---|---|
| Variable light (vl) domain | DIQMTQSPSSLSASVGDRVTITCQASEDIYNRLAWYQQKPGKVPKLLISGATSLESGVPSRFSGSGSGKDYTFTISSLQPEDIATYYCQQYWSSPLTFGGGTKVEIK | 353 |
| vlCDR1 | QASEDIYNRLA | 354 |
| vlCDR2 | GATSLES | 355 |
| vlCDR3 | QQYWSSPLT | 356 |

C6-30[CLDN6] L1.60

|  | sequence | SEQ ID NO: |
|---|---|---|
| Variable light (vl) domain | DIQMTQSPSSLSASVGDRVTITCQASEDIYNRLAWYQQKPGKVPKLLISGATSLETGVPSRFSGSGSGKDYTFTISSLQPEDIATYYCQQLWSSPLTFGGGTKVEIK | 357 |
| vlCDR1 | QASEDIYNRLA | 358 |
| vlCDR2 | GATSLET | 359 |
| vlCDR3 | QQLWSSPLT | 360 |

C6-30[CLDN6] L1.107

|  | sequence | SEQ ID NO: |
|---|---|---|
| Variable light (vl) domain | DIQMTQSPSSLSASVGDRVTITCQASEDIVNRLAWYQQKPGKVPKLLISGATSLETGVPSRFSGSGSGKDYTFTISSLQPEDIATYYCQQYWSSPLTFGGGTKVEIK | 361 |
| vlCDR1 | QASEDIVNRLA | 362 |
| vlCDR2 | GATSLET | 363 |
| vlCDR3 | QQYWSSPLT | 364 |

C6-30[CLDN6] L1.114

|  | sequence | SEQ ID NO: |
|---|---|---|
| Variable light (vl) domain | DIQMTQSPSSLSASVGDRVTITCQASEDIYLRLAWYQQKPGKVPKLLISGATSLETGVPSRFSGSGSGKDYTFTISSLQPEDIATYYCQQYWSSPLTFGGGTKVEIK | 365 |
| vlCDR1 | QASEDIYLRLA | 366 |
| vlCDR2 | GATSLET | 367 |
| vlCDR3 | QQYWSSPLT | 368 |

Figure 15J

C6-30[CLDN6] L1.187

| | sequence | SEQ ID NO: |
|---|---|---|
| Variable light (vl) domain | DIQMTQSPSSLSASVGDRVTITCQASEDIYNRLAWYQQKPGKVPKLL ISGATSLETGVPSRFSGSGSGKDYTFTISSLQPEDIATYYCQQYWSA PLTFGGGTKVEIK | 369 |
| vlCDR1 | QASEDIYNRLA | 370 |
| vlCDR2 | GATSLET | 371 |
| vlCDR3 | QQYWSAPLT | 372 |

C6-30[CLDN6] L1.189

| | sequence | SEQ ID NO: |
|---|---|---|
| Variable light (vl) domain | DIQMTQSPSSLSASVGDRVTITCQASEDIYNRLAWYQQKPGKVPKLL ISGATSLETGVPSRFSGSGSGKDYTFTISSLQPEDIATYYCQQYWSG PLTFGGGTKVEIK | 373 |
| vlCDR1 | QASEDIYNRLA | 374 |
| vlCDR2 | GATSLET | 375 |
| vlCDR3 | QQYWSGPLT | 376 |

Figure 16A

>XENP34218 C6-30[CLDN6]_H1_L1_IgG1_PVA_/S267K
Heavy Chain - C6-30[CLDN6]_H1
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
377)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
378)

>XENP34219 C6-30[CLDN6]_H1_L2_IgG1_PVA_/S267K
Heavy Chain - C6-30[CLDN6]_H1
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
379)

Light Chain - C6-30[CLDN6]_L2
DIQMTQSPDSLAVSLGERATINCKASEDIYNRLAWYQQKPGQVPKLLISGATSLETGVPSRFSGSGSGKDYTLTISS
LQAEDVAVYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
380)

>XENP34220 C6-30[CLDN6]_H2_L1_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
381)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
382)

Figure 16B

>XENP34221 C6-30[CLDN6]_H2_L2_IgG1_PVA_/S267K
Heavy Chain - C6-30[CLDN6]_H2
EVQLVQSGAEVKKPGESLRISCKTSGYTFT<u>EYTMH</u>WVRQMPGKSLEWMG<u>GIDPNNGNTHYNQKFQG</u>HVTISVDKSIS
TAYLQWSSLKASDTAMYYCAR<u>IYYFGRLYFDF</u>WGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
383)

Light Chain - C6-30[CLDN6]_L2
DIQMTQSPDSLAVSLGERATINC<u>KASEDIYNRLA</u>WYQQKPGQVPKLLIS<u>GATSLET</u>GVPSRFSGSGSGKDYTLTISS
LQAEDVAVYYC<u>QQYWSSPLT</u>FGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
384)

>XENP35044 C6-30[CLDN6]_H2_L1.1_IgG1_PVA_/S267K
Heavy Chain - C6-30[CLDN6]_H2
EVQLVQSGAEVKKPGESLRISCKTSGYTFT<u>EYTMH</u>WVRQMPGKSLEWMG<u>GIDPNNGNTHYNQKFQG</u>HVTISVDKSIS
TAYLQWSSLKASDTAMYYCAR<u>IYYFGRLYFDF</u>WGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
385)

Light Chain - C6-30[CLDN6]_L1.1
DIQMTQSPSSLSASVGDRVTITC<u>QASQDIYNRLA</u>WYQQKPGKVPKLLIS<u>GATSLET</u>GVPSRFSGSGSGKDYTFTISS
LQPEDIATYYC<u>QQYWSSPLT</u>FGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSF (SEQ ID NO: 386)

>XENP35047 C6-30[CLDN6]_H2_L1.4_IgG1_PVA_/S267K
Heavy Chain - C6-30[CLDN6]_H2
EVQLVQSGAEVKKPGESLRISCKTSGYTFT<u>EYTMH</u>WVRQMPGKSLEWMG<u>GIDPNNGNTHYNQKFQG</u>HVTISVDKSIS
TAYLQWSSLKASDTAMYYCAR<u>IYYFGRLYFDF</u>WGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
387)

Light Chain - C6-30[CLDN6]_L1.4
DIQMTQSPSSLSASVGDRVTITC<u>QASEDVYNRLA</u>WYQQKPGKVPKLLIS<u>GATSLET</u>GVPSRFSGSGSGKDYTFTISS
LQPEDIATYYC<u>QQYWSSPLT</u>FGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
388)

Figure 16C

>XENP35050 C6-30[CLDN6]_H2_L1.7_IgG1_PVA_/S267K
Heavy Chain - C6-30[CLDN6]_H2
EVQLVQSGAEVKKPGESLRISCKTSGYTFT<u>EYTMH</u>WVRQMPGKSLEWMG<u>GIDPNNGNTHYNQKFQG</u>HVTISVDKSIS
TAYLQWSSLKASDTAMYYCAR<u>IYYFGRLYFDF</u>WGAGTLVTSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 389)

Light Chain - C6-30[CLDN6]_L1.7
DIQMTQSPSSLSASVGDRVTITC<u>QASEDIYSRLA</u>WYQQKPGKVPKLLIS<u>GATSLET</u>GVPSRFSGSGSGKDYTFTISS
LQPEDIATYYC<u>QQYWSSPLT</u>FGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 390)

>XENP35059 C6-30[CLDN6]_H2_L1.16_IgG1_PVA_/S267K
Heavy Chain - C6-30[CLDN6]_H2
EVQLVQSGAEVKKPGESLRISCKTSGYTFT<u>EYTMH</u>WVRQMPGKSLEWMG<u>GIDPNNGNTHYNQKFQG</u>HVTISVDKSIS
TAYLQWSSLKASDTAMYYCAR<u>IYYFGRLYFDF</u>WGAGTLVTSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 391)

Light Chain - C6-30[CLDN6]_L1.16
DIQMTQSPSSLSASVGDRVTITC<u>QASEDIYNRLA</u>WYQQKPGKVPKLLIS<u>AATSLET</u>GVPSRFSGSGSGKDYTFTISS
LQPEDIATYYC<u>QQYWSSPLT</u>FGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 392)

>XENP35061 C6-30[CLDN6]_H2_L1.18_IgG1_PVA_/S267K
Heavy Chain - C6-30[CLDN6]_H2
EVQLVQSGAEVKKPGESLRISCKTSGYTFT<u>EYTMH</u>WVRQMPGKSLEWMG<u>GIDPNNGNTHYNQKFQG</u>HVTISVDKSIS
TAYLQWSSLKASDTAMYYCAR<u>IYYFGRLYFDF</u>WGAGTLVTSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 393)

Light Chain - C6-30[CLDN6]_L1.18
DIQMTQSPSSLSASVGDRVTITC<u>QASEDIYNRLA</u>WYQQKPGKVPKLLIS<u>GTTSLET</u>GVPSRFSGSGSGKDYTFTISS
LQPEDIATYYC<u>QQYWSSPLT</u>FGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 394)

Figure 16D

>XENP35062 C6-30[CLDN6]_H2_L1.19_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
395)

Light Chain - C6-30[CLDN6]_L1.19
DIQMTQSPSSLSASVGDRVTITCQASEDIYNRLAWYQQKPGKVPKLLISGASSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
396)

>XENP35064 C6-30[CLDN6]_H2_L1.21_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
397)

Light Chain - C6-30[CLDN6]_L1.21
DIQMTQSPSSLSASVGDRVTITCQASEDIYNRLAWYQQKPGKVPKLLISGATNLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
398)

>XENP35065 C6-30[CLDN6]_H2_L1.22_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
399)

Light Chain - C6-30[CLDN6]_L1.22
DIQMTQSPSSLSASVGDRVTITCQASEDIYNRLAWYQQKPGKVPKLLISGATQLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
400)

Figure 16E

>XENP35066 C6-30[CLDN6]_H2_L1.23_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 401)

Light Chain - C6-30[CLDN6]_L1.23
DIQMTQSPSSLSASVGDRVTITCQASEDIYNRLAWYQQKPGKVPKLLISGATSRETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 402)

>XENP35070 C6-30[CLDN6]_H2_L1.27_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 403)

Light Chain - C6-30[CLDN6]_L1.27
DIQMTQSPSSLSASVGDRVTITCQASEDIYNRLAWYQQKPGKVPKLLISGATSLESGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 404)

>XENP35085 C6-30[CLDN6]_H1.1_L1_IgG1_PVA_/S267K
Heavy Chain - C6-30[CLDN6]_H1.1
QVQLVQSGAEVKKPGASVKVSCKTSGYTFTEYTMHWVRQAPGQSLEWMGGISPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 405)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 406)

Figure 16F

>XENP35086 C6-30[CLDN6]_H1.2_L1_IgG1_PVA_/S267K
Heavy Chain - C6-30[CLDN6]_H1.2
QVQLVQSGAEVKKPGASVKVSCKTSGYTFTEYTMHWVRQAPGQSLEWMGGINPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
407)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
408)

>XENP35087 C6-30[CLDN6]_H1.3_L1_IgG1_PVA_/S267K
Heavy Chain - C6-30[CLDN6]_H1.3
QVQLVQSGAEVKKPGASVKVSCKTSGYTFTEYTMHWVRQAPGQSLEWMGGIDSNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
409)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
410)

>XENP35088 C6-30[CLDN6]_H1.4_L1_IgG1_PVA_/S267K
Heavy Chain - C6-30[CLDN6]_H1.4
QVQLVQSGAEVKKPGASVKVSCKTSGYTFTEYTMHWVRQAPGQSLEWMGGIDANNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
411)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
412)

Figure 16G

>XENP35089 C6-30[CLDN6]_H1.5_L1_IgG1_PVA_/S267K
Heavy Chain - C6-30[CLDN6]_H1.5
QVQLVQSGAEVKKPGASVKVSCKTSGYTFTEYTMHWVRQAPGQSLEWMGGIDPQNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 413)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 414)

>XENP35090 C6-30[CLDN6]_H1.6_L1_IgG1_PVA_/S267K
Heavy Chain - C6-30[CLDN6]_H1.6
QVQLVQSGAEVKKPGASVKVSCKTSGYTFTEYTMHWVRQAPGQSLEWMGGIDPNSGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 415)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 416)

>XENP35091 C6-30[CLDN6]_H1.7_L1_IgG1_PVA_/S267K
Heavy Chain - C6-30[CLDN6]_H1.7
QVQLVQSGAEVKKPGASVKVSCKTSGYTFTEYTMHWVRQAPGQSLEWMGGIDPNQGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 417)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 418)

Figure 16H

>XENP35092 C6-30[CLDN6]_H1.8_L1_IgG1_PVA_/S267K
Heavy Chain - C6-30[CLDN6]_H1.8
QVQLVQSGAEVKKPGASVKVSCKTSGYTFT<u>EYTMH</u>WVRQAPGQSLEWMG<u>GIDPNNDNTHYNQKFQG</u>RVTITVDKSAS
TAYMELSSLRSEDTAVYYCAR<u>IYYFGRLYFDF</u>WGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
419)

Light Chain - C6-30[CLDN6]_L1
DIQMTQSPSSLSASVGDRVTITC<u>QASEDIYNRLA</u>WYQQKPGKVPKLLIS<u>GATSLET</u>GVPSRFSGSGSGKDYTFTISS
LQPEDIATYYC<u>QQYWSSPLT</u>FGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
420)

>XENP35093 C6-30[CLDN6]_H1.9_L1_IgG1_PVA_/S267K
Heavy Chain - C6-30[CLDN6]_H1.9
QVQLVQSGAEVKKPGASVKVSCKTSGYTFT<u>EYTMH</u>WVRQAPGQSLEWMG<u>GIDPNNANTHYNQKFQG</u>RVTITVDKSAS
TAYMELSSLRSEDTAVYYCAR<u>IYYFGRLYFDF</u>WGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
421)

Light Chain - C6-30[CLDN6]_L1
DIQMTQSPSSLSASVGDRVTITC<u>QASEDIYNRLA</u>WYQQKPGKVPKLLIS<u>GATSLET</u>GVPSRFSGSGSGKDYTFTISS
LQPEDIATYYC<u>QQYWSSPLT</u>FGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
422)

>XENP35094 C6-30[CLDN6]_H2.1_L1_IgG1_PVA_/S267K
Heavy Chain - C6-30[CLDN6]_H2.1
EVQLVQSGAEVKKPGESLRISCKTSGYTFT<u>EYTMH</u>WVRQMPGKSLEWMG<u>GISPNNGNTHYNQKFQG</u>HVTISVDKSIS
TAYLQWSSLKASDTAMYYCAR<u>IYYFGRLYFDF</u>WGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
423)

Light Chain - C6-30[CLDN6]_L1
DIQMTQSPSSLSASVGDRVTITC<u>QASEDIYNRLA</u>WYQQKPGKVPKLLIS<u>GATSLET</u>GVPSRFSGSGSGKDYTFTISS
LQPEDIATYYC<u>QQYWSSPLT</u>FGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
424)

Figure 16I

>XENP35095 C6-30[CLDN6]_H2.2_L1_IgG1_PVA_/S267K
Heavy Chain - C6-30[CLDN6]_H2.2
EVQLVQSGAEVKKPGESLRISCKTSGYTFTEYTMHWVRQMPGKSLEWMGGITPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
425)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
426)

>XENP35096 C6-30[CLDN6]_H2.3_L1_IgG1_PVA_/S267K
Heavy Chain - C6-30[CLDN6]_H2.3
EVQLVQSGAEVKKPGESLRISCKTSGYTFTEYTMHWVRQMPGKSLEWMGGIDSNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
427)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
428)

>XENP35097 C6-30[CLDN6]_H2.4_L1_IgG1_PVA_/S267K
Heavy Chain - C6-30[CLDN6]_H2.4
EVQLVQSGAEVKKPGESLRISCKTSGYTFTEYTMHWVRQMPGKSLEWMGGIDGNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
429)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
430)

Figure 16J

>XENP35098 C6-30[CLDN6]_H2.5_L1_IgG1_PVA_/S267K
Heavy Chain - C6-30[CLDN6]_H2.5
EVQLVQSGAEVKKPGESLRISCKTSGYTFTEYTMHWVRQMPGKSLEWMGGIDPQNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 431)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 432)

>XENP35099 C6-30[CLDN6]_H2.6_L1_IgG1_PVA_/S267K
Heavy Chain - C6-30[CLDN6]_H2.6
EVQLVQSGAEVKKPGESLRISCKTSGYTFTEYTMHWVRQMPGKSLEWMGGIDPNDGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 433)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 434)

>XENP35100 C6-30[CLDN6]_H2.7_L1_IgG1_PVA_/S267K
Heavy Chain - C6-30[CLDN6]_H2.7
EVQLVQSGAEVKKPGESLRISCKTSGYTFTEYTMHWVRQMPGKSLEWMGGIDPNQGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 435)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 436)

Figure 16K

>XENP35101 C6-30[CLDN6]_H2.8_L1_IgG1_PVA_/S267K
Heavy Chain - C6-30[CLDN6]_H2.8
EVQLVQSGAEVKKPGESLRISCKTSGYTFTEYTMHWVRQMPGKSLEWMGGIDPNNDNTHYNQKFQGHVTISVDKSIS
TAYLQWSSLKASDTAMYYCARIYYFGRLYFDFWGAGTLVTSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
437)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
438)

>XENP35102 C6-30[CLDN6]_H2.9_L1_IgG1_PVA_/S267K
Heavy Chain - C6-30[CLDN6]_H2.9
EVQLVQSGAEVKKPGESLRISCKTSGYTFTEYTMHWVRQMPGKSLEWMGGIDPNNANTHYNQKFQGHVTISVDKSIS
TAYLQWSSLKASDTAMYYCARIYYFGRLYFDFWGAGTLVTSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
439)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
440)

>XENP35865 C6-30[CLDN6]_H2_L1.60_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
441)

Light Chain - C6-30[CLDN6]_L1.60
DIQMTQSPSSLSASVGDRVTITCQASEDIYNRLAWYQQKPGKVPKLLISGATSLETGVPSRFSGSGSGKDYTFTISS
LQPEDIATYYCQQLWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
442)

Figure 16L

>XENP35883 C6-30[CLDN6]_H1.19_L1_IgG1_PVA_/S267K
Heavy Chain - C6-30[CLDN6]_H1.19
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTATYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
443)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
444)

>XENP35886 C6-30[CLDN6]_H1.22_L1_IgG1_PVA_/S267K
Heavy Chain - C6-30[CLDN6]_H1.22
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARILYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
445)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
446)

>XENP35888 C6-30[CLDN6]_H1.24_L1_IgG1_PVA_/S267K
Heavy Chain - C6-30[CLDN6]_H1.24
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYLGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
447)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
448)

Figure 16M

>XENP35890 C6-30[CLDN6]_H2.11_L1_IgG1_PVA_/S267K
Heavy Chain - C6-30[CLDN6]_H2.11
EVQLVQSGAEVKKPGESLRISCKTSGYSFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
449)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
450)

>XENP35891 C6-30[CLDN6]_H2.12_L1_IgG1_PVA_/S267K
Heavy Chain - C6-30[CLDN6]_H2.12
EVQLVQSGAEVKKPGESLRISCKTSGYDFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
451)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
452)

>XENP35979 C6-30[CLDN6]_H2_L1.187_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
453)

Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
454)

Figure 16N

>XENP35981 C6-30[CLDN6]_H2_L1.189_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 455)

Light Chain - C6-30[CLDN6]_L1.189
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 456)

>XENP35929 C6-30[CLDN6]_H2_L1.107_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 457)

Light Chain - C6-30[CLDN6]_L1.107
DIQMTQSPSSLSASVGDRVTITCQASEDIVNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 458)

>XENP35936 C6-30[CLDN6]_H2_L1.114_IgG1_PVA_/S267K
Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 459)

Light Chain - C6-30[CLDN6]_L1.114
DIQMTQSPSSLSASVGDRVTITCQASEDIYLRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 460)

Figure 16O

>XENP36021 C6-30[CLDN6]_H2.71_L1_IgG1_PVA_/S267K
Heavy Chain - C6-30[CLDN6]_H2.71
EVQLVQSGAEVKKPGESLRISCKTSGYTFTEYTMHWVRQMPGKSLEWMGGIDLNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
461)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
462)

>XENP36022 C6-30[CLDN6]_H2.72_L1_IgG1_PVA_/S267K
Heavy Chain - C6-30[CLDN6]_H2.72
EVQLVQSGAEVKKPGESLRISCKTSGYTFTEYTMHWVRQMPGKSLEWMGGIDANNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
463)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
464)

>XENP36025 C6-30[CLDN6]_H2.75_L1_IgG1_PVA_/S267K
Heavy Chain - C6-30[CLDN6]_H2.75
EVQLVQSGAEVKKPGESLRISCKTSGYTFTEYTMHWVRQMPGKSLEWMGGIDPHNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
465)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
466)

Figure 16P

>XENP36040 C6-30[CLDN6]_H2.90_L1_IgG1_PVA_/S267K
Heavy Chain - C6-30[CLDN6]_H2.90
EVQLVQSGAEVKKPGESLRISCKTSGYTFTEYTMHWVRQMPGKSLEWMGGIDPNNLNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 467)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 468)

>XENP36041 C6-30[CLDN6]_H2.91_L1_IgG1_PVA_/S267K
Heavy Chain - C6-30[CLDN6]_H2.91
EVQLVQSGAEVKKPGESLRISCKTSGYTFTEYTMHWVRQMPGKSLEWMGGIDPNNFNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 469)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 470)

>XENP36065 C6-30[CLDN6]_H2.118_L1_IgG1_PVA_/S267K
Heavy Chain - C6-30[CLDN6]_H2.118
EVQLVQSGAEVKKPGESLRISCKTSGYTFTEYTMHWVRQMPGKSLEWMGGIDPNNGNTHYNQKKQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 471)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 472)

Figure 16Q

>XENP36066 C6-30[CLDN6]_H2.119_L1_IgG1_PVA_/S267K
Heavy Chain - C6-30[CLDN6]_H2.119
EVQLVQSGAEVKKPGESLRISCKTSGYTFTEYTMHWVRQMPGKSLEWMGGIDPNNGNTHYNQKFEGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
473)

Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
474)

>XENP36956 C6-30[CLDN6]_H1.22_L1.187_IgG1_PVA_/S267K
Heavy Chain - C6-30[CLDN6]_H1.22
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARILYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
475)

Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
476)

>XENP36960 C6-30[CLDN6]_H1.22_L1.189_IgG1_PVA_/S267K
Heavy Chain - C6-30[CLDN6]_H1.22
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARILYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
477)

Light Chain - C6-30[CLDN6]_L1.189
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
478)

Figure 16R

>XENP36968 C6-30[CLDN6]_H2.3_L1.189_IgG1_PVA_/S267K
Heavy Chain - C6-30[CLDN6]_H2.3
EVQLVQSGAEVKKPGESLRISCKTSGYTFTEYTMHWVRQMPGKSLEWMGGIDSNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
479)

Light Chain - C6-30[CLDN6]_L1.189
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
480)

>XENP36963 C6-30[CLDN6]_H1.9_L1.189_IgG1_PVA_/S267K
Heavy Chain - C6-30[CLDN6]_H1.9
QVQLVQSGAEVKKPGASVKVSCKTSGYTFTEYTMHWVRQAPGQSLEWMGGIDPNNANTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
481)

Light Chain - C6-30[CLDN6]_L1.189
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
482)

>XENP36964 C6-30[CLDN6]_H2.3_L1.187_IgG1_PVA_/S267K
Heavy Chain - C6-30[CLDN6]_H2.3
EVQLVQSGAEVKKPGESLRISCKTSGYTFTEYTMHWVRQMPGKSLEWMGGIDSNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
483)

Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
484)

Figure 16S

>XENP36965 C6-30[CLDN6]_H2.12_L1.187_IgG1_PVA_/S267K
Heavy Chain - C6-30[CLDN6]_H2.12
EVQLVQSGAEVKKPGESLRISCKTSGYDFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 485)

Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 486)

>XENP36957 C6-30[CLDN6]_H1.24_L1.187_IgG1_PVA_/S267K
Heavy Chain - C6-30[CLDN6]_H1.24
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYLGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 487)

Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 488)

>XENP36958 C6-30[CLDN6]_H1.19_L1.187_IgG1_PVA_/S267K
Heavy Chain - C6-30[CLDN6]_H1.19
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTATYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 489)

Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 490)

Figure 16T

>XENP36959 C6-30[CLDN6]_H1.9_L1.187_IgG1_PVA_/S267K
Heavy Chain - C6-30[CLDN6]_H1.9
QVQLVQSGAEVKKPGASVKVSCKTSGYTFTEYTMHWVRQAPGQSLEWMGGIDPNNANTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 491)

Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 492)

>XENP36961 C6-30[CLDN6]_H1.24_L1.189_IgG1_PVA_/S267K
Heavy Chain - C6-30[CLDN6]_H1.24
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYLGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 493)

Light Chain - C6-30[CLDN6]_L1.189
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 494)

>XENP36962 C6-30[CLDN6]_H1.19_L1.189_IgG1_PVA_/S267K
Heavy Chain - C6-30[CLDN6]_H1.19
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTATYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 495)

Light Chain - C6-30[CLDN6]_L1.189
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 496)

Figure 16U

>XENP36966 C6-30[CLDN6]_H2.91_L1.187_IgG1_PVA_/S267K
Heavy Chain - C6-30[CLDN6]_H2.91
EVQLVQSGAEVKKPGESLRISCKTSGYTFTEYTMHWVRQMPGKSLEWMGGIDPNNFNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
497)

Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
498)

>XENP36967 C6-30[CLDN6]_H2.118_L1.187_IgG1_PVA_/S267K
Heavy Chain - C6-30[CLDN6]_H2.118
EVQLVQSGAEVKKPGESLRISCKTSGYTFTEYTMHWVRQMPGKSLEWMGGIDPNNGNTHYNQKKQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
499)

Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
500)

>XENP36969 C6-30[CLDN6]_H2.12_L1.189_IgG1_PVA_/S267K
Heavy Chain - C6-30[CLDN6]_H2.12
EVQLVQSGAEVKKPGESLRISCKTSGYDFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
501)

Light Chain - C6-30[CLDN6]_L1.189
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
502)

Figure 16V

>XENP36970 C6-30[CLDN6]_H2.91_L1.189_IgG1_PVA_/S267K
Heavy Chain - C6-30[CLDN6]_H2.91
EVQLVQSGAEVKKPGESLRISCKTSGYTFTEYTMHWVRQMPGKSLEWMGGIDPNNFNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
503)

Light Chain - C6-30[CLDN6]_L1.189
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
504)

>XENP36972 C6-30[CLDN6]_H1_L1.187_IgG1_PVA_/S267K
Heavy Chain - C6-30[CLDN6]_H1
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
505)

Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
506)

>XENP36971 C6-30[CLDN6]_H2.118_L1.189_IgG1_PVA_/S267K
Heavy Chain - C6-30[CLDN6]_H2.118
EVQLVQSGAEVKKPGESLRISCKTSGYTFTEYTMHWVRQMPGKSLEWMGGIDPNNGNTHYNQKKQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
507)

Light Chain - C6-30[CLDN6]_L1.189
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
508)

Figure 16W

>XENP36973 C6-30[CLDN6]_H1_L1.189_IgG1_PVA_/S267K
Heavy Chain - C6-30[CLDN6]_H1
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:
509)

Light Chain - C6-30[CLDN6]_L1.189
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
510)

1 + 1 Fab-scFv-Fc

1 + 1 Fab$_2$-scFv-Fc

Figure 18

>XENP26863 mAb206-LCC[CLDN6]_H0L0_IgG1_PVA_/S267K
Heavy Chain - mAb206-LCC[CLDN6]_H0
EVQLQQSGPELVKPGASMKISCKASGYSFT<u>GYTMN</u>WVKQSHGKNLEWIG<u>LINPYNGGTIYNQKFKG</u>KATLTVDKSSS
TAYMELLSLTSEDSAVYYCAR<u>DYGFVLDY</u>WGQGTTLTVSS/ASTKGPSVFPLAPSSKSTSGGTAALGCLVKDYFPEP
VTVSWNSGALTSGVHTFPAVL<u>Q</u>SSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK (SEQ ID NO:
511)

Light Chain - mAb206-LCC[CLDN6]_L0
QIVLTQSPAIMSASPGEKVTITC<u>SASSSVSYLH</u>WFQQKPGTSPKLWVY<u>STSNLPS</u>GVPARFGGSGSGTSYSLTISRM
EAEDAATYYC<u>QQRSIYPPWT</u>FGGGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
512)

>XENP26849 mAb206-LCC[CLDN6]_H0L0_Fab-[ANTI-CD3]_H1.30_L1.47_scFv(GKPGS)4-IgG1_pI(-)_Isosteric_A_/PVA_/S267K/L368D/K370S-Fc(216)_IgG1_C220S/PVA_/S267K/S364K/E357Q
Chain 1 - mAb206-LCC[CLDN6]_H0_IgG1_pI(-)_Isosteric_A_/PVA_/S267K/L368D/K370S
EVQLQQSGPELVKPGASMKISCKASGYSFT<u>GYTMN</u>WVKQSHGKNLEWIG<u>LINPYNGGTIYNQKFKG</u>KATLTVDKSSS
TAYMELLSLTSEDSAVYYCAR<u>DYGFVLDY</u>WGQGTTLTVSS/ASTKGPSVFPLAPSSKSTSGGTAALGCLVKDYFPEP
VTVSWNSGALTSGVHTFPAVL<u>Q</u>SSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK (SEQ ID NO:
513)

Chain 2 - [ANTI-CD3]_H1.30_L1.47_scFv(GKPGS)4_Fc(216)_IgG1_C220S/PVA_/S267K/S364K/E357Q
EVQLVESGGGLVQPGGSLRLSCAASGFTFS<u>TYAMN</u>WVRQAPGKGLEWVGR<u>IRSKYNNYATYYADSVKG</u>RFTISRDDS
KNTLYLQMNSLRAEDTAVYYCVR<u>HGNFGDSYVSWFAY</u>WGQGTLVTVSS/GKPGSGKPGSGKPGSKPGS/QAVVTQE
PSLTVSPGGTVTLTCGSST<u>GAVTTSNYAN</u>WVQQKPGKSPRGLIGG<u>TNKRAP</u>GVPARFSGSLLGGKAALTISGAQPED
EADYYC<u>ALWYSNHW</u>VFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 514)

Chain 3 - mAb206-LCC[CLDN6]_L0
QIVLTQSPAIMSASPGEKVTITC<u>SASSSVSYLH</u>WFQQKPGTSPKLWVY<u>STSNLPS</u>GVPARFGGSGSGTSYSLTISRM
EAEDAATYYC<u>QQRSIYPPWT</u>FGGGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC        (SEQ ID NO:
515)

Figure 19

>XENP34229 C6-30[CLDN6]_H1_L1_Fab-[ANTI-CD3]_L1.47_H1.30_scFv(GKPGS)4-IgG1_PVA_/S267K IgG1_pI(-)_Isosteric_A_PVA_/S267K/L368D/K370S-Fc(216)_IgG1_C220S/PVA_/S267K/S364K/E357Q

Chain 1 - C6-30[CLDN6]_H1_IgG1_PVA_/S267K IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 516)

Chain 2 - [ANTI-CD3]_L1.47_H1.30_scFv(GKPGS)4_Fc(216)_IgG1_C220S/PVA_/S267K/S364K/E357Q
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKYNNYATYYADSVKGRFTISRDDSKNTLYLQMNSLRAEDTAVYYCVR
HGNFGDSYVSWFAYWGQGTLVTVSS/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 517)

Chain 3 - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 518)

>XENP34637 C6-30[CLDN6]_H2_L1-[ANTI-CD3]_H1.30_L1.47_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - C6-30[CLDN6]_H2_L1_IgG1_pI(-)_Isosteric_A_PVA_/S267K/L368D/K370S
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 519)

Chain 2 - [ANTI-CD3]_H1.30_L1.47_scFv(GKPGS)4_Fc(216)_IgG1_C220S/PVA_/S267K/S364K/E357Q
EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 520)

Chain 3 - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 521)

Figure 20

>XENP35385 C6-30[CLDN6]_H1_L1_Fab-[ANTI-CD3]_L1.47_H1.32_scFv(GKPGS)4-IgG1_PVA_/S267K IgG1_pI(-)_Isosteric_A_PVA_/S267K/L368D/K370S-Fc(216)_IgG1_C220S/PVA_/S267K/S364K/E357Q
Chain 1 - C6-30[CLDN6]_H1_IgG1_PVA_/S267K IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYFGRLYFDFWGAGTLVTSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 522)

Chain 2 - [ANTI-CD3]_L1.47_H1.32_scFv(GKPGS)4_Fc(216)_IgG1_C220S/PVA_/S267K/S364K/E357Q
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKANNYATYYADSVKGRFTISRDDSKNTLYLQMNSLRAEDTAVYYCVR
HGNFGDSYVSWFAYWGQGTLVTVSS/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 523)

Chain 3 - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 524)

>XENP35387 C6-30[CLDN6]_H2_L1_Fab-[ANTI-CD3]_L1.47_H1.32_scFv(GKPGS)4-IgG1_PVA_/S267K IgG1_pI(-)_Isosteric_A_PVA_/S267K/L368D/K370S-Fc(216)_IgG1_C220S/PVA_/S267K/S364K/E357Q
Chain 1 - C6-30[CLDN6]_H2_IgG1_PVA_/S267K IgG1_pI(-)_Isosteric_A_PVA_/S267K/L368D/K370S
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 525)

Chain 2 - [ANTI-CD3]_L1.47_H1.32_scFv(GKPGS)4_Fc(216)_IgG1_C220S/PVA_/S267K/S364K/E357Q
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKANNYATYYADSVKGRFTISRDDSKNTLYLQMNSLRAEDTAVYYCVR
HGNFGDSYVSWFAYWGQGTLVTVSS/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 526)

Chain 3 - C6-30[CLDN6]_L1
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 527)

Figure 21A

>XENP34233 C6-30[CLDN6]_H1_L1_Fab-C6-30[CLDN6]_H1_L1_Fab_(G4S)2_[ANTI-CD3]_L1.47_H1.30_scFv(GKPGS)4_(G4S)2_Fc(222)_IgG1_PVA_/S267K/S364K/E357Q-IgG1_pI(-)_Isosteric_A_PVA_/S267K/L368D/K370S

Chain 1 - C6-30[CLDN6]_H1_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO:
528)

Chain 2 - C6-30[CLDN6]_H1_Fab_(G4S)2_[ANTI-CD3]_L1.47_H1.30_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKYNNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 529)

Chain 3 - C6-30[CLDN6]_L1_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
530)

Figure 21B

>XENP34638 C6-30[CLDN6]_H2_L1_Fab-C6-30[CLDN6]_H2_L1_Fab_(G4S)2_[ANTI-CD3]_L1.47_H1.30_scFv(GKPGS)4_(G4S)2-IgG1_pI(-)_Isosteric_A_PVA_/S267K/L368D/K370S-Fc(222)_IgG1_PVA_/S267K/S364K/E357Q

Chain 1 - C6-30[CLDN6]_H2_IgG1_pI(-)_Isosteric_A_PVA_/S267K/L368D/K370S
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 531)

Chain 2 - C6-30[CLDN6]_H2_(G4S)2_[ANTI-CD3]_L1.47_H1.30_scFv(GKPGS)4_(G4S)2_Fc(222)_IgG1_PVA_/S267K/S364K/E357Q
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKYNNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 532)

Chain 3 - C6-30[CLDN6]_L1_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 533)

Figure 22A

>XENP35386 C6-30[CLDN6]_H1_L1_Fab-C6-30[CLDN6]_H1_L1_Fab_(G4S)2_[ANTI-CD3]_L1.47_H1.32_scFv(GKPGS)4_(G4S)2-IgG1_pI(-)_Isosteric_A_PVA_/S267K/L368D/K370S-Fc(222)_IgG1_PVA_/S267K/S364K/E357Q

Chain 1 - C6-30[CLDN6]_H1_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 534)

Chain 2 - C6-30[CLDN6]_H1_L1_Fab_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 535)

Chain 3 - C6-30[CLDN6]_L1_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 536)

>XENP35388 C6-30[CLDN6]_H2_L1_Fab-C6-30[CLDN6]_H2_L1_Fab_(G4S)2_[ANTI-CD3]_L1.47_H1.32_scFv(GKPGS)4_(G4S)2-IgG1_pI(-)_Isosteric_A_PVA_/S267K/L368D/K370S-Fc(222)_IgG1_PVA_/S267K/S364K/E357Q

Chain 1 - C6-30[CLDN6]_H2_IgG1_pI(-)_Isosteric_A_PVA_/S267K/L368D/K370S
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 537)

Figure 22B

Chain 2 - C6-30[CLDN6]_H2_L1_Fab_(G4S)2_Fc(222)_IgG1_PVA_/S267K/S364K/E357Q
EVQLVQSGAEVKKPGESLRISCKTSGYTFTEYTMHWVRQMPGKSLEWMGGIDPNNGNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 538)

Chain 3 - C6-30[CLDN6]_ L1_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSSPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 539)

>XENP37227 C6-30[CLDN6]_H1.9_L1.187_Fab-C6-30[CLDN6]_H1.9_L1.187_Fab_(G4S)2_[ANTI-CD3]_L1.47_H1.32_scFv(GKPGS)4_(G4S)2-IgG1_pI(-)_Isosteric_A_PVA_/S267K/L368D/K370S-Fc(222)_IgG1_PVA_/S267K/S364K/E357Q

Chain 1 - C6-30[CLDN6]_H1.9_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNANTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 540)

Chain 2 - C6-30[CLDN6]_H1.9_(G4S)2_[ANTI-CD3]_L1.47_H1.32_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNANTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 541)

Chain 3 - C6-30[CLDN6]_L1.187_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 542)

Figure 22C

**>XENP37228 C6-30[CLDN6]_H1.19_L1.187_Fab-C6-30[CLDN6]_H1.19_L1.187_Fab_(G4S)2_[ANTI-
CD3]_L1.47_H1.32_scFv(GKPGS)4_(G4S)2-IgG1_pI(-)_Isosteric_A_PVA_/S267K/L368D/K370S-
Fc(222)_IgG1_PVA_/S267K/S364K/E357Q**

Chain 1 - C6-30[CLDN6]_H1.19_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTATYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO:
543)

**Chain 2 - C6-30[CLDN6]_H1.19_(G4S)2_[ANTI-
CD3]_L1.47_H1.32_scFv(GKPGS)4_(G4S)2_Fc(222)_IgG1_PVA_/S267K/S364K/E357Q**
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTATYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 544)

Chain 3 - C6-30[CLDN6]_L1.187_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
545)

**>XENP37229 C6-30[CLDN6]_H1.22_L1.187_Fab-C6-30[CLDN6]_H1.22_L1.187_Fab_(G4S)2_[ANTI-
CD3]_L1.47_H1.32_scFv(GKPGS)4_(G4S)2-IgG1_pI(-)_Isosteric_A_PVA_/S267K/L368D/K370S-
Fc(222)_IgG1_PVA_/S267K/S364K/E357Q**

Chain 1 - C6-30[CLDN6]_H1.22_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARILYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO:
546)

Figure 22D

Chain 2 - C6-30[CLDN6]_H1.22_(G4S)2_[ANTI-CD3]_L1.47_H1.32_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARILYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 547)

Chain 3 - C6-30[CLDN6]_L1.187_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
548)

>XENP37230 C6-30[CLDN6]_H1.22_L1.189_Fab-C6-30[CLDN6]_H1.22_L1.189_Fab_(G4S)2_[ANTI-CD3]_L1.47_H1.32_scFv(GKPGS)4_(G4S)2-IgG1_pI(-)_Isosteric_A_PVA_/S267K/L368D/K370S-Fc(222)_IgG1_PVA_/S267K/S364K/E357Q
Chain 1 - C6-30[CLDN6]_H1.22_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARILYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO:
549)

Chain 2 - C6-30[CLDN6]_H1.22_(G4S)2_[ANTI-CD3]_L1.47_H1.32_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARILYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 550)

Chain 3 - C6-30[CLDN6]_L1.189_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
551)

Figure 22E

>XENP37231 C6-30[CLDN6]_H1.24_L1.187_Fab-C6-30[CLDN6]_H1.24_L1.187_Fab_(G4S)2_[ANTI-CD3]_L1.47_H1.32_scFv(GKPGS)4_(G4S)2-IgG1_pI(-)_Isosteric_A_PVA_/S267K/L368D/K370S-Fc(222)_IgG1_PVA_/S267K/S364K/E357Q

Chain 1 - C6-30[CLDN6]_H1.24_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYLGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 552)

Chain 2 - C6-30[CLDN6]_H1.24_(G4S)2_[ANTI-CD3]_L1.47_H1.32_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYLGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 553)

Chain 3 - C6-30[CLDN6]_L1.187_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 554)

>XENP37232 C6-30[CLDN6]_H1.24_L1.189_Fab-C6-30[CLDN6]_H1.24_L1.189_Fab_(G4S)2_[ANTI-CD3]_L1.47_H1.32_scFv(GKPGS)4_(G4S)2-IgG1_pI(-)_Isosteric_A_PVA_/S267K/L368D/K370S-Fc(222)_IgG1_PVA_/S267K/S364K/E357Q

Chain 1 - C6-30[CLDN6]_H1.24_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYLGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 555)

Figure 22F

Chain 2 - C6-30[CLDN6]_H1.24_(G4S)2_[ANTI-CD3]_L1.47_H1.32_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYLGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 556)

Chain 3 - C6-30[CLDN6]_L1.189_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSGPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 557)

>XENP37233 C6-30[CLDN6]_H2.91_L1.187_Fab-C6-30[CLDN6]_H2.91_L1.187_Fab_(G4S)2_[ANTI-CD3]_L1.47_H1.32_scFv(GKPGS)4_(G4S)2-IgG1_pI(-)_Isosteric_A_PVA_/S267K/L368D/K370S-Fc(222)_IgG1_PVA_/S267K/S364K/E357Q
Chain 1 - C6-30[CLDN6]_H2.91_IgG1_pI(-)_Isosteric_A_PVA_/S267K/L368D/K370S
EVQLVQSGAEVKKPGESLRISCKTSGYTFTEYTMHWVRQMPGKSLEWMGGIDPNNFNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO: 558)

Chain 2 - C6-30[CLDN6]_H2.91_(G4S)2_[ANTI-CD3]_L1.47_H1.32_scFv(GKPGS)4_(G4S)2_Fc(222)_IgG1_PVA_/S267K/S364K/E357Q
EVQLVQSGAEVKKPGESLRISCKTSGYTFTEYTMHWVRQMPGKSLEWMGGIDPNNFNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 559)

Chain 3 - C6-30[CLDN6]_L1.187_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 560)

Figure 22G

>XENP37547 C6-30[CLDN6]_H2.91_L1.187_Fab-C6-30[CLDN6]_H2.91_L1.187_Fab_(G4S)2_[anti-CD3]_L1.47_H1.32_scFv(GKPGS)4_(G4S)2-IgG1_pI(-)_Isosteric_A_PVA_/S267K/L368D/K370S/M428L/N434S-Fc(222)_IgG1_PVA_/S267K/S364K/E357Q/M428L/N434S
Chain 1 - C6-30[CLDN6]_H2.91_IgG1_pI(-)_Isosteric_A_PVA_/S267K/L368D/K370S
EVQLVQSGAEVKKPGESLRISCKTSGYTFTEYTMHWVRQMPGKSLEWMGGIDPNNFNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVLHEALHSHYTQKSLSLSPGK (SEQ ID NO: 561)

Chain 2 - C6-30[CLDN6]_H2.91_(G4S)2_[anti-CD3]_L1.47_H1.32_scFv(GKPGS)4_(G4S)2_Fc(222)_IgG1_PVA_/S267K/S364K/E357Q/M428L/N434S
EVQLVQSGAEVKKPGESLRISCKTSGYTFTEYTMHWVRQMPGKSLEWMGGIDPNNFNTHYNQKFQGHVTISVDKSIS
TAYLQWSSLKASDTAMYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVLHEALHSHYTQKSLSLSPGK (SEQ ID NO: 562)

Chain 3 - C6-30[CLDN6]_L1.187_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 563)

>XENP37545 C6-30[CLDN6]_H1.24_L1.187_Fab-C6-30[CLDN6]_H1.24_L1.187_Fab_(G4S)2_[anti-CD3]_L1.47_H1.32_scFv(GKPGS)4_(G4S)2-IgG1_pI(-)_Isosteric_A_PVA_/S267K/L368D/K370S/M428L/N434S-Fc(222)_IgG1_PVA_/S267K/S364K/E357Q/M428L/N434S
Chain 1 - C6-30[CLDN6]_H1.24_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYLGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVLHEALHSHYTQKSLSLSPGK (SEQ ID NO: 564)

Figure 22H

Chain 2 - C6-30[CLDN6]_H1.24_(G4S)2_[anti-CD3]_L1.47_H1.32_scFv(GKPGS)4_(G4S)2_Fc(222)_IgG1_PVA_/S267K/S364K/E357Q/M428L/N434S
QVQLVQSGAEVKKPGASVKVSCKTSGYTFTEYTMHWVRQAPGQSLEWMGGIDPNNGNTHYNQKFQGRVTITVDKSAS
TAYMELSSLRSEDTAVYYCARIYYLGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVLHEALHSHYTQKSLSLSPGK (SEQ ID NO: 565)

Chain 3 - C6-30[CLDN6]_L1.187_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
566)

>XENP37541 C6-30[CLDN6]_H1.9_L1.187_Fab-C6-30[CLDN6]_H1.9_L1.187_Fab_(G4S)2_[anti-CD3]_L1.47_H1.32_scFv(GKPGS)4_(G4S)2-IgG1_pI(-)_Isosteric_A_PVA_/S267K/L368D/K370S/M428L/N434S-Fc(222)_IgG1_PVA_/S267K/S364K/E357Q/M428L/N434S
Chain 1 - C6-30[CLDN6]_H1.9_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNANTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVLHEALHSHYTQKSLSLSPGK (SEQ ID NO:
567)

Chain 2 - C6-30[CLDN6]_H1.9_(G4S)2_[anti-CD3]_L1.47_H1.32_scFv(GKPGS)4_(G4S)2_Fc(222)_IgG1_PVA_/S267K/S364K/E357Q/M428L/N434S
QVQLVQSGAEVKKPGASVKVSCKTSGYTFTEYTMHWVRQAPGQSLEWMGGIDPNNANTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKANNYATYYADSVKGRFTISRDDSKNTLYLQMNSLRAEDTAVY
YCVRHGNFGDSYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVLHEALHSHYTQKSLSLSPGK (SEQ ID NO: 568)

Chain 3 - C6-30[CLDN6]_L1.187_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
569)

C6-10

C6-11

C6-15

C6-21

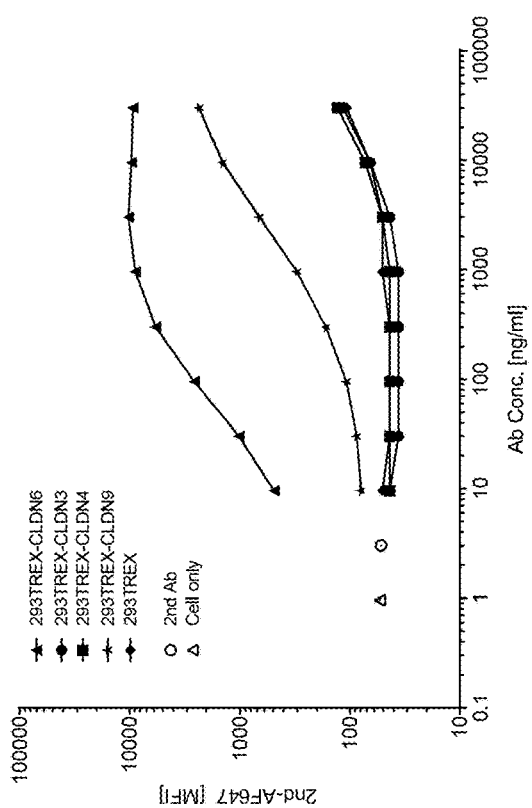
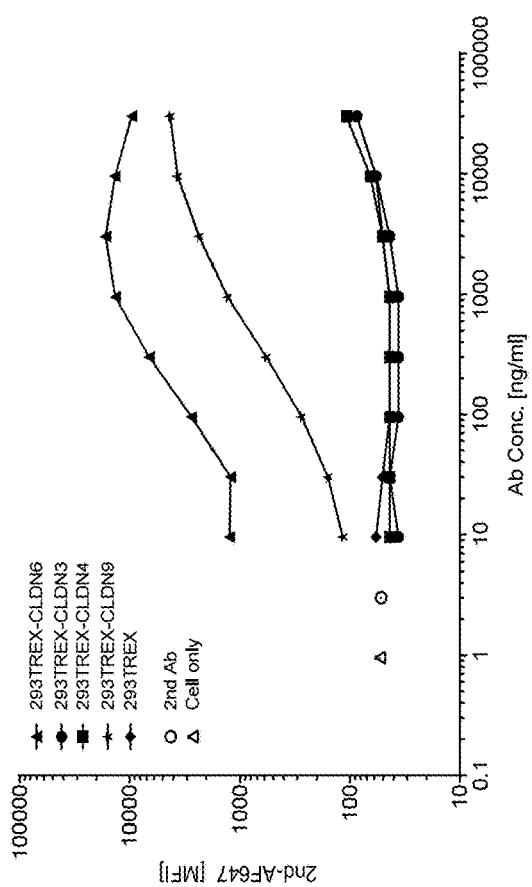

Figure 26B
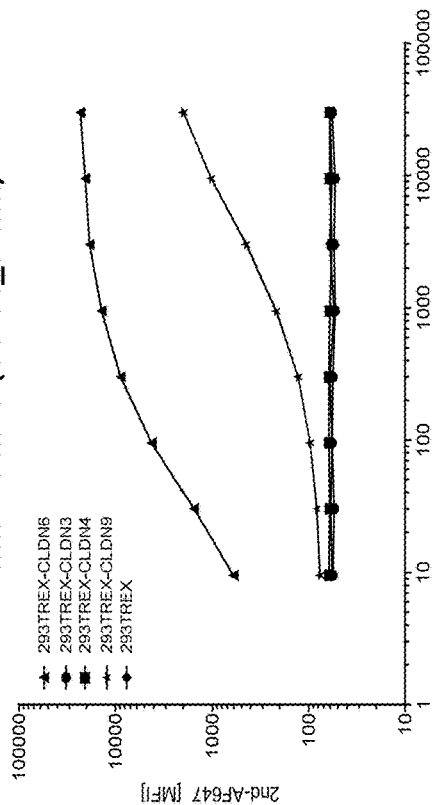
Figure 26D
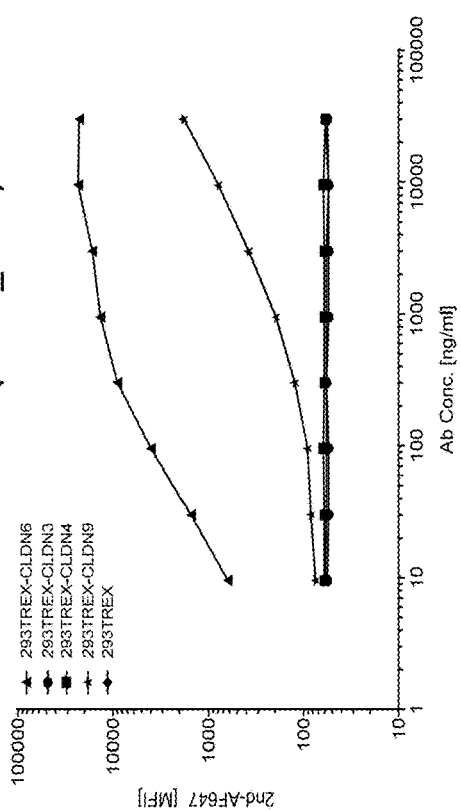
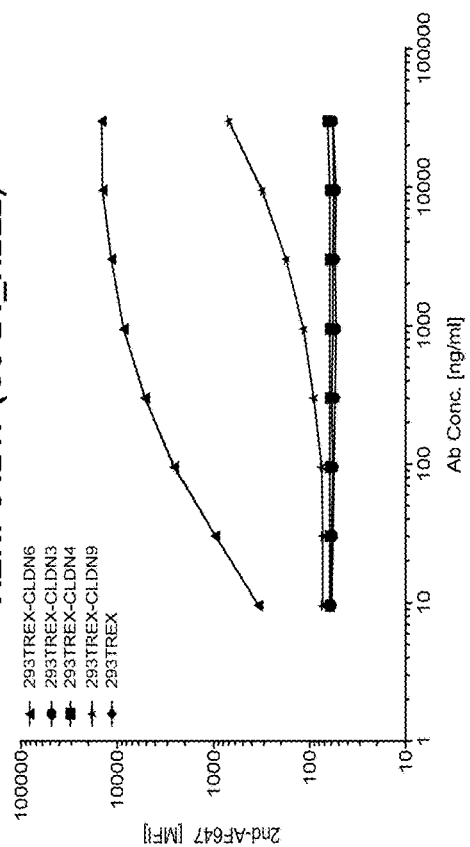
Figure 26A
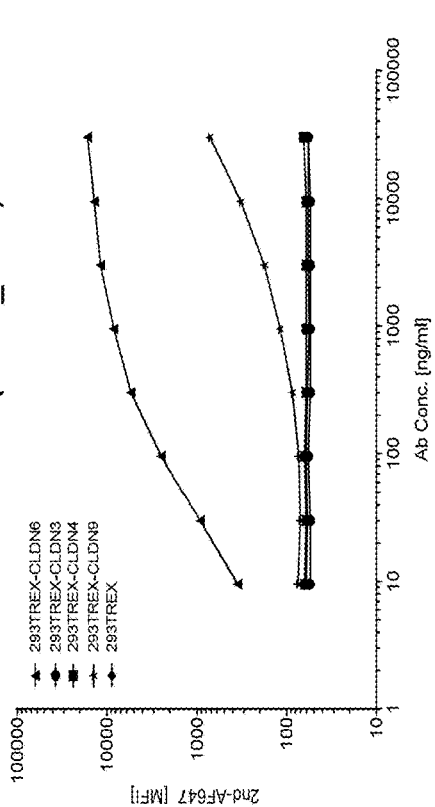
Figure 26C

Figure 27

| C6-30 Variant | VH mutation (Kabat) | Estimated CLDN6 EC50 (ng/mL) | Estimated CLDN9 EC50 (ng/mL) | Estimated CLDN9/CLDN6 EC50 ratio | CLDN9/CLDN6 EC50 ratio normalized to 30.1 H2L1 |
|---|---|---|---|---|---|
| XENP34220 | H2L1 | - | 870.8 | 5821.0 | 6.7 | 1.0 |
| XENP35085 | H1.1_L1 | D52S | 2509.0 | 15452.5 | 6.2 | 0.9 |
| XENP35086 | H1.2_L1 | D52N | 1459.0 | 12133.9 | 8.3 | 1.2 |
| XENP35087 | H1.3_L1 | P52aS | 685.5 | 2818.4 | 4.1 | 0.6 |
| XENP35088 | H1.4_L1 | P52aA | 1124.0 | 5333.3 | 4.7 | 0.7 |
| XENP35089 | H1.5_L1 | N53Q | 1696.0 | 12560.3 | 7.4 | 1.1 |
| XENP35091 | H1.7_L1 | N54Q | 666.9 | 3357.4 | 5.0 | 0.8 |
| XENP35092 | H1.8_L1 | G55D | 2017.0 | 7261.1 | 3.6 | 0.5 |
| XENP35093 | H1.9_L1 | G55A | 1042.0 | 7430.2 | 7.1 | 1.1 |
| XENP35094 | H2.1_L1 | D52S | 1802.0 | 9817.5 | 5.4 | 0.8 |
| XENP35095 | H2.2_L1 | D52T | 2111.0 | 11912.4 | 5.6 | 0.8 |
| XENP35096 | H2.3_L1 | P52aS | 1001.0 | 5116.8 | 5.1 | 0.8 |
| XENP35097 | H2.4_L1 | P52aG | 1190.0 | 4446.3 | 3.7 | 0.6 |
| XENP35098 | H2.5_L1 | N53Q | 2204.0 | 7063.2 | 3.2 | 0.5 |
| XENP35099 | H2.6_L1 | N54D | 1628.0 | 13458.6 | 8.3 | 1.2 |
| XENP35100 | H2.7_L1 | N54Q | 800.6 | 3556.3 | 4.4 | 0.7 |
| XENP35101 | H2.8_L1 | G55D | 1190.0 | 9183.3 | 7.7 | 1.2 |

Figure 31A

| A) | C6-30 Variant | EC50 (ng/ml) | | CLDN9/6 ratio |
|---|---|---|---|---|
| | | On CLDN6 | On CLDN9 | |
| XENP26863 | COMPARATOR | 273.8 | 7374 | 26.93 |
| XENP34218 | H1_L1 | 1241 | 54237 | 43.70 |
| XENP34220 | H2_L1 | 1632 | 43826 | 26.85 |
| XENP35044 | H2_L1.1 | 4338 | NA | NA |
| *XENP35047* | H2_L1.4 | 795.2 | 17550 | 22.07 |
| XENP35050 | H2_L1.7 | 2218 | 99339 | 44.79 |
| XENP35059 | H2_L1.16 | 1276 | 32669 | 25.60 |
| XENP35061 | H2_L1.18 | 1248 | 56295 | 45.11 |
| XENP35062 | H2_L1.19 | 1225 | 86760 | 70.82 |
| XENP35064 | H2_L1.21 | 979.2 | 14147 | 14.45 |
| XENP35065 | H2_L1.22 | 1478 | 69069 | 46.73 |
| XENP35066 | H2_L1.23 | 1590 | 31803 | 20.00 |
| XENP35070 | H2_L1.27 | 1183 | 29684 | 25.09 |
| XENP35087 | *H1.3_L1* | 1198 | 31760 | 26.51 |
| XENP35088 | H1.4_L1 | 1286 | 29242 | 22.74 |
| XENP35090 | H1.6_L1 | 1556 | 44628 | 28.68 |
| XENP35091 | H1.7_L1 | 1433 | 31427 | 21.93 |
| XENP35092 | H1.8_L1 | 1160 | 24998 | 21.55 |
| XENP35093 | H1.9_L1 | 978 | 53115 | 54.31 |
| XENP35096 | H2.3_L1 | 1241 | 110298 | 88.88 |
| XENP35097 | H2.4_L1 | 1103 | 72866 | 66.06 |
| XENP35100 | H2.7_L1 | 1139 | 63509 | 55.76 |
| XENP35101 | H2.8_L1 | 24783 | 1061 | 0.04 |
| XENP35102 | H2.9_L1 | 3526 | 1432 | 0.41 |

Figure 31B

| | | EC50 (ng/ml) | | |
|---|---|---|---|---|
| B) | C6-30 Variant | On CLDN6 | On CLDN9 | CLDN9/6 ratio |
| XENP26863 | COMPARATOR | 73.97 | 1874 | 25.33 |
| XENP34218 | H1_L1 | 344.3 | 11556 | 33.56 |
| XENP34220 | H2_L1 | 390.8 | 11056 | 28.29 |
| XENP35090 | H1.6_L1 | 902.7 | 7062 | 7.82 |
| XENP35865 | H2_L1.60 | 685.7 | 123972 | 180.80 |
| XENP35883 | H1.19_L1 | 617.2 | 16767 | 27.17 |
| XENP35886 | H1.22_L1 | 941.1 | 24483 | 26.02 |
| XENP35888 | H1.24_L1 | 657.4 | 43820 | 66.66 |
| XENP35890 | H2.11_L1 | 408.1 | 34071 | 83.49 |
| XENP35891 | H2.12_L1 | 473.6 | 44135 | 93.19 |
| XENP35929 | H2_L1.107 | 791.8 | 99068 | 125.12 |
| XENP35936 | H2_L1.114 | 828.6 | 57436 | 69.32 |
| XENP35979 | H2_L1.187 | 323 | 29169 | 90.31 |
| XENP35981 | H2_L1.189 | 403.5 | 31700 | 78.56 |
| XENP36021 | H2.71_L1 | 902.4 | 49328 | 54.66 |
| XENP36022 | H2.72_L1 | 513.9 | 47177 | 91.80 |
| XENP36025 | H2.75_L1 | 1343 | 61089 | 45.49 |
| XENP36040 | H2.90_L1 | 705.5 | 66108 | 93.70 |
| XENP36041 | H2.91_L1 | 449.4 | 32521 | 72.37 |
| XENP36065 | H2.118_L1 | 783 | 491857 | 628.17 |
| XENP36066 | H2.119_L1 | 567 | 18031 | 31.80 |

Figure 33

| C6-30 Variants | CLDN6 EC50 | CLDN9 EC50 | CLDN9/CLDN6 EC50 Ratio | CLDN6 AUC | CLDN9 AUC | CLDN6/CLDN9 AUC Ratio |
|---|---|---|---|---|---|---|
| XENP34218_H1L1 | 373.2 | 8594 | 23.02787 | 3.88E+09 | 1.38E+09 | 2.802246 |
| XENP34220_H2L1 | 294.7 | 10485 | 35.57855 | 3.62E+09 | 1.64E+09 | 2.20981 |
| XENP26863 (COMPARATOR) | 42.24 | 2146 | 50.80492 | 2.55E+09 | 1.58E+09 | 1.616028 |
| XENP36956_H1.22_L1.187 | 658.3 | 29584 | 44.94 | 4.07E+09 | 1.61E+08 | 25.34196 |
| XENP36957_H1.24_L1.187 | 305.3 | 21240 | 69.57091 | 4.63E+09 | 4.41E+08 | 10.49091 |
| XENP36958_H1.19_L1.187 | 414.6 | 17235 | 41.57019 | 4.91E+09 | 4.92E+08 | 9.969486 |
| XENP36959_H1.9_L1.187 | 392.2 | 18873 | 48.12086 | 4.92E+09 | 5.09E+08 | 9.67232 |
| XENP36960_H1.22_L1.189 | 1072 | 60046 | 56.01306 | 3.93E+09 | 1.88E+08 | 20.88547 |
| XENP36961_H1.24_L1.189 | 562.1 | 31368 | 55.80502 | 4.63E+09 | 4.2E+08 | 11.03723 |
| XENP36962_H1.19_L1.189 | 450.1 | 15252 | 33.8858 | 4.6E+09 | 6.85E+08 | 6.710047 |
| XENP36963_H1.9_L1.189 | 451.6 | 25916 | 57.38707 | 4.69E+09 | 6.73E+08 | 6.95726 |
| XENP36964_H2.3_L1.187 | 259.5 | 26066 | 100.447 | 4.42E+09 | 4.94E+08 | 8.951393 |
| XENP36965_H2.12_L1.187 | 279.1 | 16705 | 59.8531 | 4.57E+09 | 5.79E+08 | 7.881124 |
| XENP36966_H2.91_L1.187 | 349.9 | 19604 | 56.02744 | 5.27E+09 | 5.24E+08 | 10.05439 |
| XENP36967_H2.118_L1.187 | 313.6 | 26403 | 84.19324 | 4.29E+09 | 4.38E+08 | 9.796817 |
| XENP36968_H2.3_L1.189 | 452 | 36292 | 80.29204 | 4.37E+09 | 5.86E+08 | 7.458967 |
| XENP36969_H2.12_L1.189 | 295.1 | 11508 | 38.99695 | 4.02E+09 | 7.66E+08 | 5.251557 |
| XENP36970_H2.91_L1.189 | 394.6 | 24490 | 62.06285 | 4.91E+09 | 6.15E+08 | 7.988906 |
| XENP36971_H2.118_L1.189 | 378.8 | 14082 | 37.17529 | 3.6E+09 | 5.18E+08 | 6.948966 |
| XENP36972_H1_L1.187 | 307.6 | 16192 | 52.63979 | 4.9E+09 | 5.34E+08 | 9.166706 |
| XENP36973_H1_L1.189 | 466.5 | 18579 | 39.82637 | 4.55E+09 | 8.06E+08 | 5.640381 |

CLDN6

CLDN9

Bottle Opener or
1+1 Fab-scFv-Fc

Dual scFv

One-arm central-scFv

One-arm scFv-mAb scFv-mAb

Central scFv or
2+1 Fab2-scFv-Fc mAb-Fv mAb-scFv central-Fv

Bispecific mAb

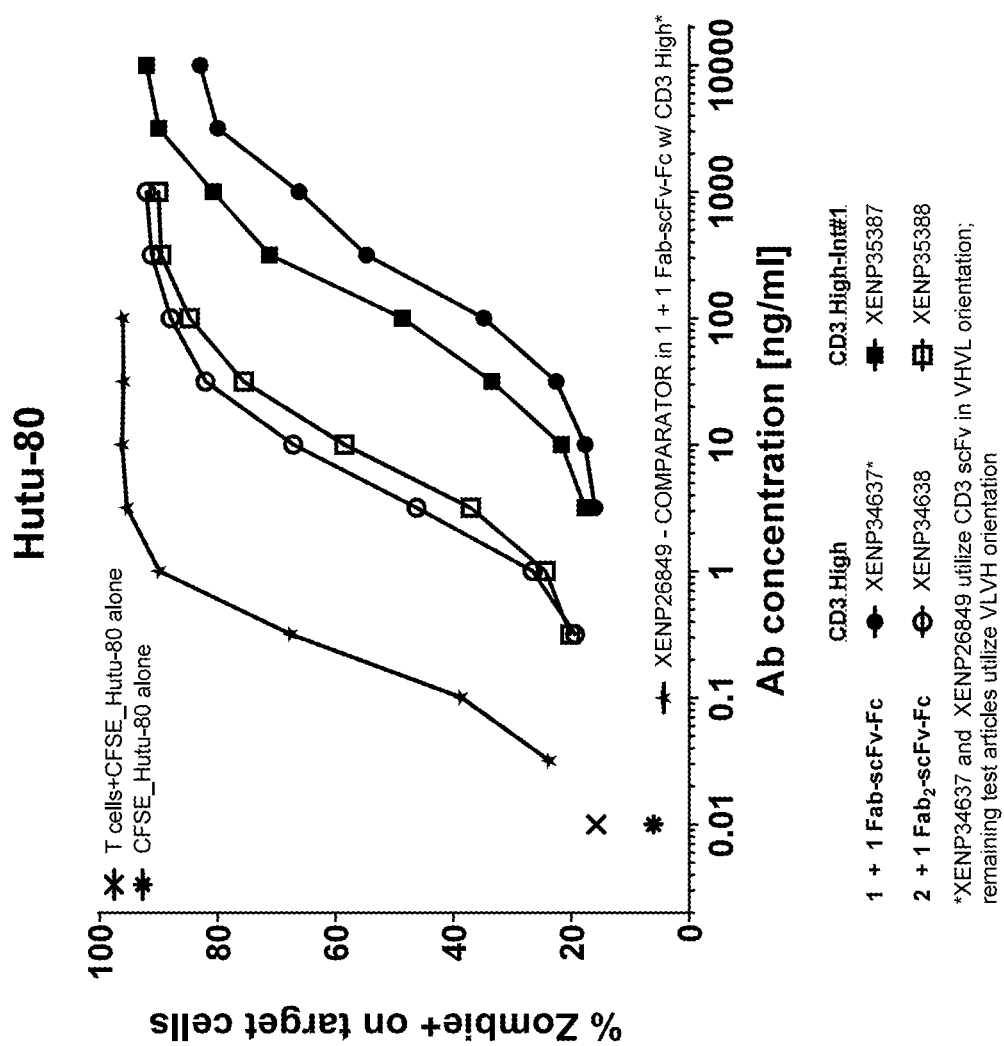

Figure 42

| EC50_%Zombie+ on targets (ng/mL) | | |
|---|---|---|
| | PA-1 | OV-90 |
| XENP34229 | 287 | 200.3 |
| XENP34233 | 12.44 | 14.38 |
| XENP34637 | 469.7 | 590.5 |
| XENP34638 | 5.989 | 9.29 |
| XENP26849 | 0.1084 | 0.299 |
| XENP28817 | 1.352 | 5.173 |
| XENP35385 | 570.1 | 472 |
| XENP35386 | 14.26 | 19.19 |
| XENP35387 | 1045 | 908.3 |

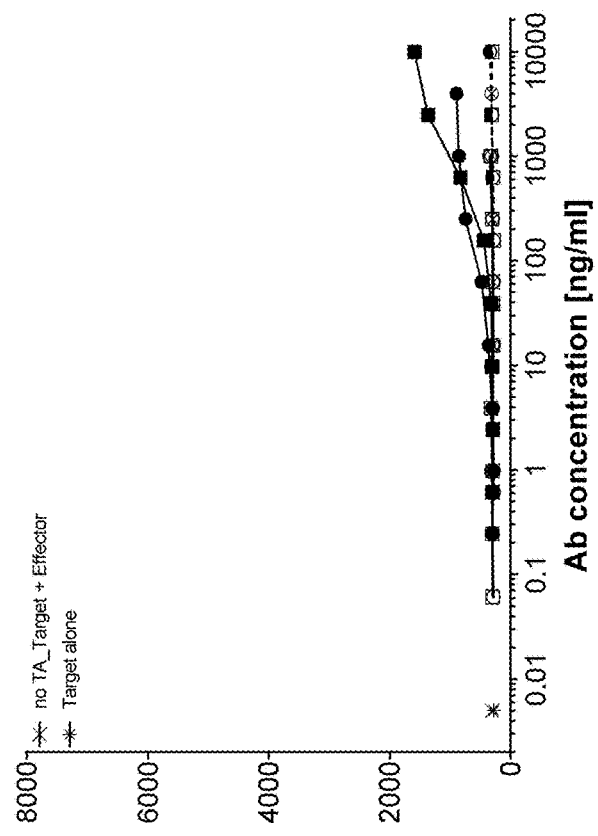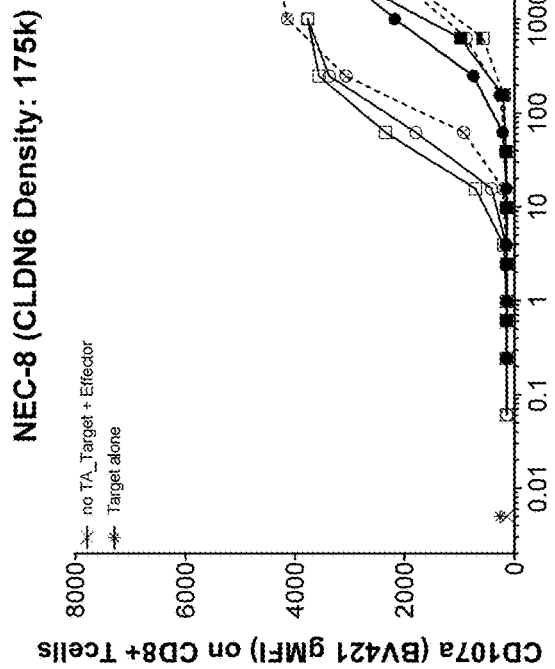

Figure 44

| EC50_CD107a on CD8+ | | | | |
|---|---|---|---|---|
| | PA-1 | OV-90 | NEC-8 | COV-318 |
| XENP34229 | 322.6 | 1097 | 1178 | 118 |
| XENP34233 | 13.18 | 67.02 | 88.68 | |
| XENP34637 | 512.9 | 1714 | 1909 | 1012 |
| XENP34638 | 7.561 | 44.08 | 54.54 | |
| XENP26849 | 0.2754 | 2.396 | 2.285 | 22.29 |
| XENP28817 | 2.064 | 23.56 | 20.21 | 38.66 |
| XENP35385 | 686.7 | 2444 | 2383 | |
| XENP35386 | 14.72 | 103.9 | 173.2 | |
| XENP35387 | 1079 | 4280 | 3613 | |

Hutu-80

| XENP | EC50 (ng/ml) |
|---|---|
| 37227 | 5.4 |
| 37228 | 7 |
| 37229 | 857 |
| 37230 | 1426 |
| 37231 | 63 |
| 37232 | 44 |
| 37233 | 2.1 |
| 35386 | 21 |
| 35388 | 12 |

%Zombie+ on Hutu-80

CLDN9 293-TREX

Hutu-80

| %Zombie+ on Hutu-80 | |
|---|---|
| XENP | EC50 (ng/ml) |
| 37227 | 8.9 |
| 37228 | 10 |
| 37229 | 447 |
| 37230 | 1004 |
| 37231 | 38 |
| 37232 | 66 |
| 37233 | 7.2 |
| 35386 | 23 |

CLDN9 293-TREX

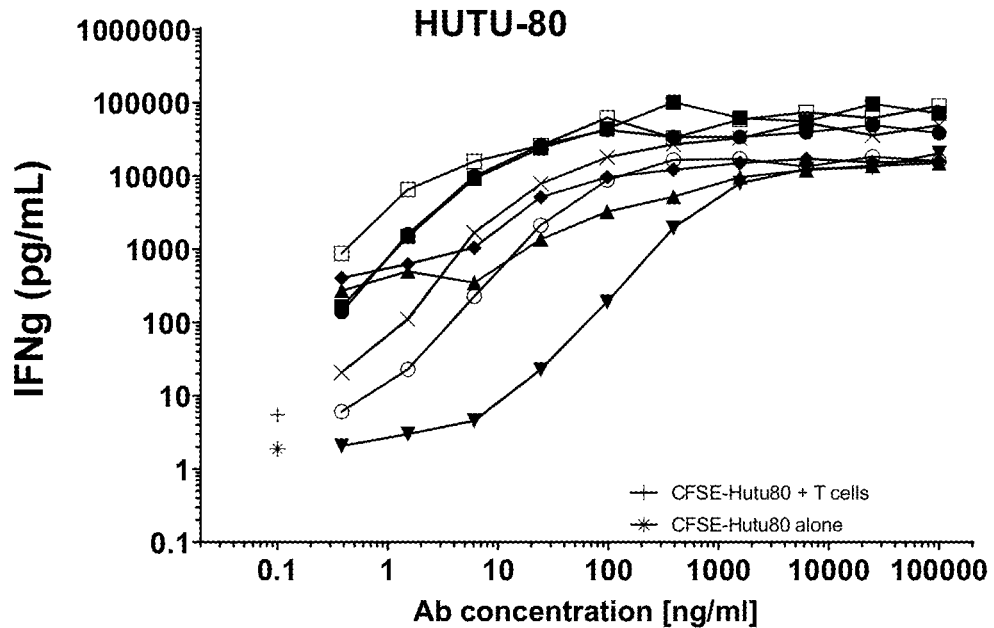
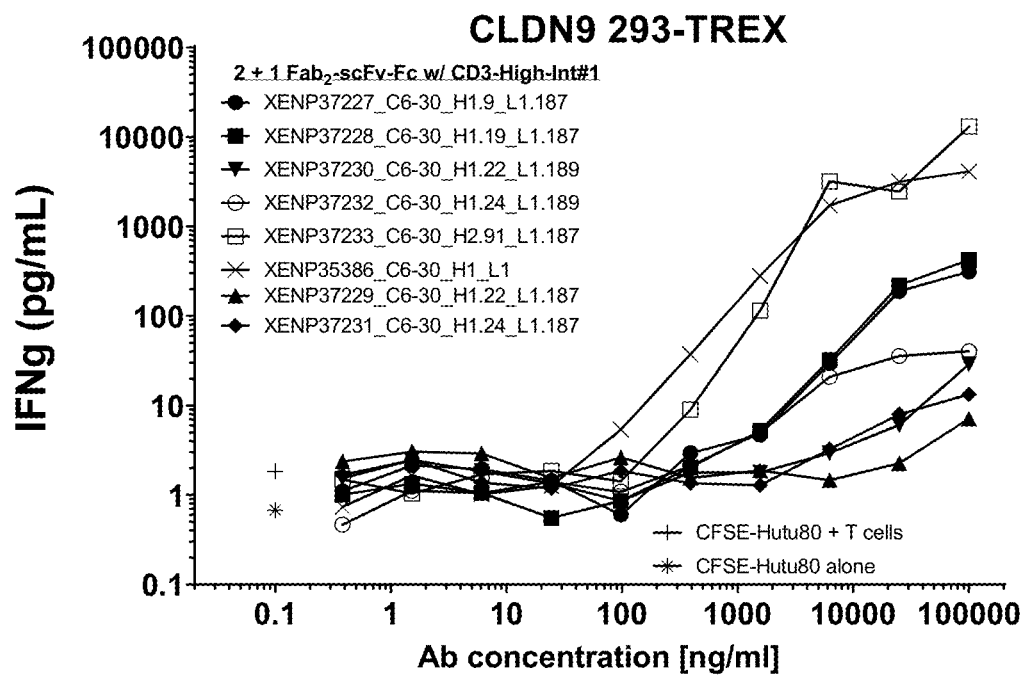

XENP37227 C6-30_H1.9_L1.187
2 + 1 Fab$_2$-scFv-Fc w/ CD3 High-Int#1

XENP37228 C6-30_H1.19_L1.187
2 + 1 Fab$_2$-scFv-Fc w/ CD3 High-Int#1

XENP37229_C6-30_H1.22_L1.187
2 + 1 Fab$_2$-scFv-Fc w/ CD3 High-Int#1

XENP37230_C6-30_H1.22_L1.189
2 + 1 Fab$_2$-scFv-Fc w/ CD3 High-Int#1

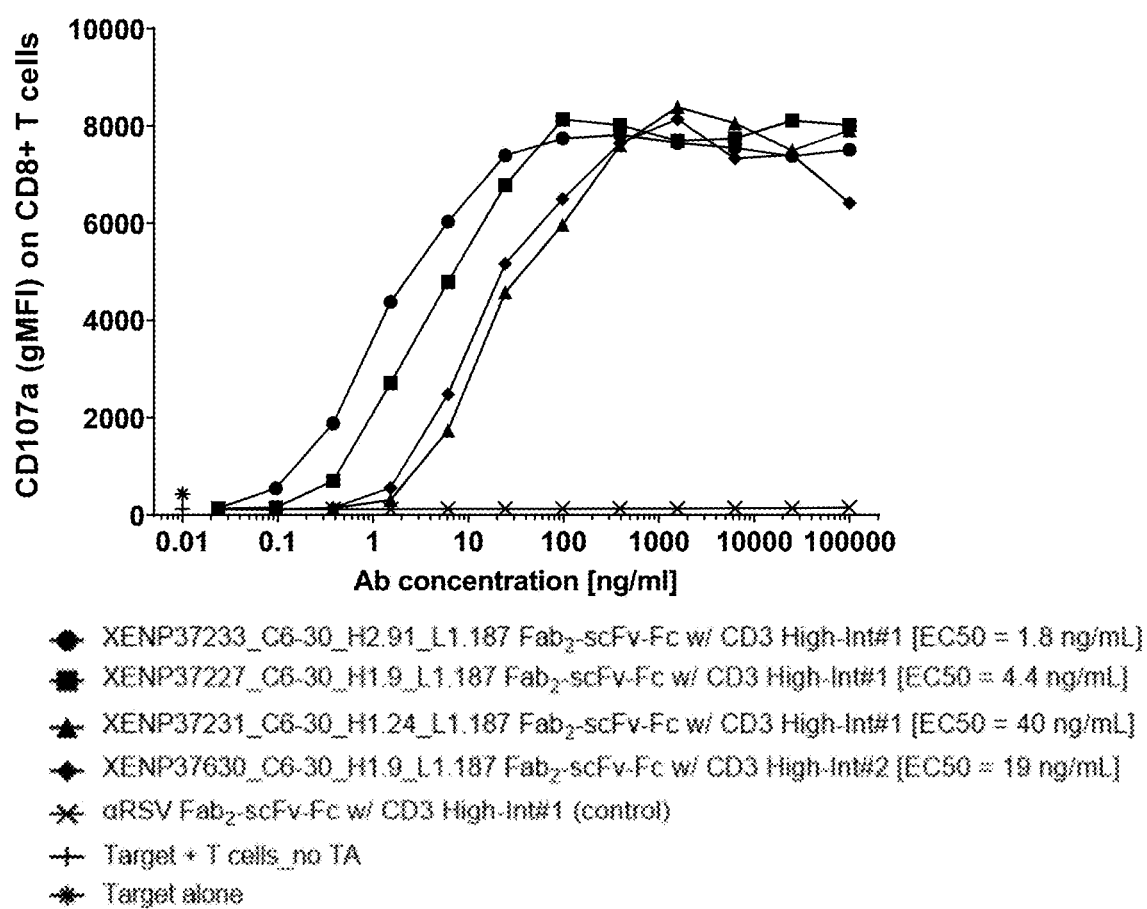

Figure 59A

>XENP37630 C6-30[CLDN6]_H1.9_L1.187_Fab-C6-30[CLDN6]_H1.9_L1.187_Fab_(G4S)2_[anti-CD3]_L1.47_H1.89_scFv(GKPGS)4_(G4S)2-IgG1_pI(-)_Isosteric_A_PVA_/S267K/L368D/K370S-Fc(222)_IgG1_PVA_/S267K/S364K/E357Q
Chain 1 - C6-30[CLDN6]_H1.9_IgG1_pI(-)_Isosteric_A_PVA_/S267K/L368D/K370S
QVQLVQSGAEVKKPGASVKVSCKTSGYTFTEYTMHWVRQAPGQSLEWMGGIDPNNANTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK (SEQ ID NO:
570)

Chain 2 - C6-30[CLDN6]_H1.9_(G4S)2_[anti-CD3]_L1.47_H1.89_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNANTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKYNNYATYYADSVKGRFTISRDDSKNTLYLQMNSLRAEDTAVY
YCVRHGNFGDEYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK (SEQ ID NO: 571)

Chain 3 - C6-30[CLDN6]_L1.187_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
572)

>XENP37634 C6-30[CLDN6]_H1.9_L1.187_Fab-C6-30[CLDN6]_H1.9_L1.187_Fab_(G4S)2_[anti-CD3]_L1.47_H1.89_scFv(GKPGS)4_(G4S)2-IgG1_pI(-)_Isosteric_A_PVA_/S267K/L368D/K370S/M428L/N434S-Fc(222)_IgG1_PVA_/S267K/S364K/E357Q/M428L/N434S
Chain 1 - C6-30[CLDN6]_H1.9_IgG1_pI(-)_Isosteric_A_PVA_/S267K/L368D/K370S/M428L/N434S
QVQLVQSGAEVKKPGASVKVSCKTSGYTFTEYTMHWVRQAPGQSLEWMGGIDPNNANTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVLHEALHSHYTQKSLSLSPGK (SEQ ID NO:
573)

Figure 59B

Chain 2 - C6-30[CLDN6]_H1.9_(G4S)2_[anti-CD3]_L1.47_H1.89_scFv(GKPGS)4_(G4S)2_Fc(222)_IgG1_PVA_/S267K/S364K/E357Q/M428L/N434S
QVQLVQSGAEVKKPGASVKVSCKTSGYTFTEYTMHWVRQAPGQSLEWMGGIDPNNANTHYNQKFQGRVTITVDKSAS
TAYMELSSLRSEDTAVYYCARIYYFGRLYFDFWGAGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCGGGGSGG
GGS/QAVVTQEPSLTVSPGGTVTLTCGSSTGAVTTSNYANWVQQKPGKSPRGLIGGTNKRAPGVPARFSGSLLGGKA
ALTISGAQPEDEADYYCALWYSNHWVFGGGTKLTVL/GKPGSGKPGSGKPGSGKPGS/EVQLVESGGGLVQPGGSLR
LSCAASGFTFSTYAMNWVRQAPGKGLEWVGRIRSKYNNYATYYADSVKGRFTISRDDSKNTLYLQMNSLRAEDTAVY
YCVRHGNFGDEYVSWFAYWGQGTLVTVSS/GGGGSGGGGSKTHTCPPCPAPPVAGPSVFLFPPKPKDTLMISRTPEV
TCVVVDVKHEDPEVKFNWYVDGVEVHNAKTKPREEQYNSTYRVVSVLTVLHQDWLNGKEYKCKVSNKALPAPIEKTI
SKAKGQPREPQVYTLPPSREQMTKNQVKLTCLVKGFYPSDIAVEWESNGQPENNYKTTPPVLDSDGSFFLYSKLTVD
KSRWQQGNVFSCSVLHEALHSHYTQKSLSLSPGK (SEQ ID NO: 574)

Chain 3 - C6-30[CLDN6]_L1.187_Light Chain
DIQMTQSPSSLSASVGDRVTITCQASEDIYNRLAWYQQKPGKVPKLLISGATSLETGVPSRFSGSGSGKDYTFTISS
LQPEDIATYYCQQYWSAPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 575)

Figure 60A

>XENP37217_Comp_CH02[CLDN6]_H0L0_Fab-
Comp_CH02[CLDN6]_H0L0_Fab_(G4S)2_SP34_L1.47_H1.32_scFv(GKPGS)4_(G4S)2-IgG1_pI(-
)_Isosteric_A_PVA_/S267K/L368D/K370S-Fc(222)_IgG1_PVA_/S267K/S364K/E357Q
Chain 1- Comp_CH02[CLDN6]_H0_Fab_(G4S)2_SP34_L1.47_H1.32_scFv(GKPGS)4_(G4S)2 -
Fc(222)_IgG1_PVA_/S267K/S364K/E357Q
EVQVEQSGLELVKPGASVKISCKTSGYTFTEYTMHWVKQSHGKSLEWIGGINPNNGNTRYNQKFKDKATLTVDKSSR
TAYMELHTLTSEDSAVYYCARCGDYDLFFFFAYWGQGTLVTVSA/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/GGGGS
GGGGS/QAVVTQEPSLTVSPGGTVTLTCGSSTGAVTTSNYANWVQQKPGKSPRGLIGGTNKRAPGVPARFSGSLLGG
KAALTISGAQPEDEADYYCALWYSNHWVFGGGTKLTVL/GKPGSGKPGSGKPGSGKPGS/EVQLVESGGGLVQPGGS
LRLSCAASGFTFSTYAMNWVRQAPGKGLEWVGRIRSKANNYATYYADSVKGRFTISRDDSKNTLYLQMNSLRAEDTA
VYYCVRHGNFGDSYVSWFAYWGQGTLVTVSS/GGGGSGGGGS/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK (SEQ ID NO: 576)

Chain 2- Comp_CH02[CLDN6]_H0_Fab -IgG1_pI(-)_Isosteric_A_PVA_/S267K/L368D/K370S
EVQVEQSGLELVKPGASVKISCKTSGYTFTEYTMHWVKQSHGKSLEWIGGINPNNGNTRYNQKFKDKATLTVDKSSR
TAYMELHTLTSEDSAVYYCARCGDYDLFFFFAYWGQGTLVTVSA/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK (SEQ ID
NO: 577)

Chain 3- Comp_CH02[CLDN6]_L0_Light Chain
DIVMTQFQKFMSTSVGDRVSVTCKASQNVGTNVAWYQQKPGQSFEALISSASSRFSGVPDRFTGSGSGTDFTLTITN
VQSEDLADYFCQQYNSFPFTFGSGTELEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:
578)

>XENP38084_Comp_CH02[CLDN6]_H0_L0
Chain 1- Comp_CH02[CLDN6]_H0_Heavy Chain
EVQVEQSGLELVKPGASVKISCKTSGYTFTEYTMHWVKQSHGKSLEWIGGINPNNGNTRYNQKFKDKATLTVDKSSR
TAYMELHTLTSEDSAVYYCARCGDYDLFFFFAYWGQGTLVTVSA/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPELLGGPSVFLFPPKPKDTLMISRTPEVTCVVVDVSHEDPEVKFNWYVDGVEVHNAKTKPREEQYASTYRVV
SVLTVLHQDWLNGKEYKCKVSNKALPAPIEKTISKAKGQPREPQVYTLPPSREEMTKNQVSLTCLVKGFYPSDIAVE
WESNGQPENNYKTTPPYLDSDGSFFLYSKLTVDKSRWQQGNVFSCSVMHEALHNHYTQESLSLSP (SEQ ID NO:
579)

Figure 60B

Chain 2- Comp_CH02[CLDN6]_H0_L0
DIVMTQFQKFMSTSVGDRVSVTCKASQNVGTNVAWYQQKPGQSPEALISSASSRFSGVPDRFTGSGSGTDFTLTITN
VQSEDLADYFCQQYNSFPFTFGSGTELEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO: 580)

HETERODIMERIC ANTIBODIES THAT BIND CD3 AND CLDN6

PRIORITY CLAIM

This application claims the benefit of U.S. Provisional Patent Application No. 63/158,584, filed Mar. 9, 2021, which is hereby incorporated by reference in its entirety.

SEQUENCE LISTING

The instant application contains a Sequence Listing which has been submitted electronically in ASCII format and is hereby incorporated by reference in its entirety. Said ASCII copy, created on Feb. 24, 2022, is named 067461-5281-WO_SL.txt and is 991,664 bytes in size

BACKGROUND

Antibody-based therapeutics have been used successfully to treat a variety of diseases, including cancer. An increasingly prevalent avenue being explored is the engineering of single immunoglobulin molecules that co-engage two different antigens. Such alternate antibody formats that engage two different antigens are often referred to as bispecific antibodies. Because the considerable diversity of the antibody variable region (Fv) makes it possible to produce an Fv that recognizes virtually any molecule, the typical approach to bispecific antibody generation is the introduction of new variable regions into the antibody.

A particularly useful approach for bispecific antibodies is to engineer a first binding domain which engages CD3 and a second binding domain which engages an antigen associated with or upregulated on cancer cells so that the bispecific antibody redirects CD3+ T cells to destroy the cancer cells. Claudin 6 (CLDN6) has been determined to be upregulated in gastric, lung, and ovarian cancers. In view of this, it is believed that anti-CLDN6 antibodies are useful, for example, for localizing anti-tumor therapeutics (e.g., chemotherapeutic agents and T cells) to such CLDN6 expressing tumors. The present invention provides novel bispecific antibodies to CD3 and CLDN6 that are capable of localizing CD3+ effector T cells to CLDN6 expressing tumors.

SUMMARY

Provided herein are novel CLDN6 binding domains, and anti-CLDN6×anti-CD3 antibodies that include such CLDN6 binding domains. Also provided herein are methods of using such antibodies for the treatment of CLDN6-associated cancers.

In a first aspect, provided herein are compositions comprising a CLDN6 antigen binding domain. In some embodiments, the CLDN6 antigen binding domain comprises a set of 6 CDRs (vhCDR1, vhCDR2, vhCDR3, vlCDR1, vlCDR2 and vlCDR3) from a variable heavy domain (VH)/variable light domain (VL) pair selected from the group consisting: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9, L1.4_H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1_L1.16, H1.2_L1.16, H1.3_L1.16, H1.4 L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1_L1.16, H2.2_L1.16, H2.3_L1.16, H2.4 L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5 L1.18, H1.6_L1.18, H1.7_L1.18, H1.8_L1.18, H1.9_L1.18, H1.19_L1.18, H1.22_L1.18, H1.24_L1.18, H2_L1.18, H2.1_L1.18, H2.2_L1.18, H2.3_L1.18, H2.4_L1.18, H2.5 L1.18, H2.6_L1.18, H2.7_L1.18, H2.8_L1.18, H2.9_L1.18, H2.11_L1.18, H2.12_L1.18, H2.71_L1.18, H2.75_L1.18, H2.90_L1.18, H2.91_L1.18, H2.118_L1.18, H2.119 L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H1.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2.

In some embodiments, the CLDN6 antigen binding domain comprises a VH/VL pair selected from the group consisting of: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9_L1.4, H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1_L1.16, H1.2 L1.16, H1.3_L1.16, H1.4_L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1_L1.16, H2.2 L1.16, H2.3_L1.16, H2.4_L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5_L1.18, H1.6_L1.18, H1.7_L1.18, H1.8_L1.18, H1.9 L1.18, H1.19_L1.18, H1.22_L1.18, H1.24_L1.18, H2_L1.18, H2.1_L1.18, H2.2_L1.18, H2.3_L1.18, H2.4_L1.18, H2.5_L1.18, H2.6_L1.18, H2.7_L1.18, H2.8_L1.18, H2.9 L1.18, H2.11_L1.18, H2.12_L1.18, H2.71_L1.18, H2.75_L1.18, H2.90_L1.18, H2.91 L1.18, H2.118_L1.18, H2.119_L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H1.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2.

3. In some embodiments, the VH/VL pair is selected from the group consisting of H1.9_L1.187, H1.24_L1.187, H2.91_L1.187 and H1.9_L1.187.

In some embodiments, the composition is a monoclonal antibody.

In another aspect, provided herein is a heterodimeric antibody comprising: a) a first monomer, b) a second monomer, and c) a light chain. The first monomer comprises: i) an anti-CD3 scFv comprising a first variable light domain, an scFv linker and a first variable heavy domain; and ii) a first Fc domain, wherein the scFv is covalently attached to the N-terminus of the first Fc domain using a domain linker. The second monomer comprises a VH2-CH1-hinge-CH2-CH3 monomer, wherein VH is a second variable heavy domain and CH2-CH3 is a second Fc domain. The light chain comprises a second variable light domain. In this embodiment, the second variable heavy domain and the second variable light domain form a CLDN6 antigen binding domain (ABD).

In some embodiments, the CLDN6 binding domain comprises a set of 6 CDRs (vhCDR1, vhCDR2, vhCDR3, vlCDR1, vlCDR2 and vlCDR3) from a variable heavy domain/variable light domain pair selected from the group consisting of: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9, L1.4_H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1 L1.16, H1.2_L1.16, H1.3_L1.16, H1.4_L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1 L1.16, H2.2_L1.16, H2.3_L1.16, H2.4_L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5_L1.18, H1.6_L1.18, H1.7_L1.18, H1.8 L1.18, H1.9_L1.18, H1.19_L1.18, H1.22_L1.18, H1.24_L1.18, H2_L1.18, H2.1_L1.18, H2.2_L1.18, H2.3_L1.18, H2.4_L1.18, H2.5_L1.18, H2.6_L1.18, H2.7_L1.18, H2.8 L1.18, H2.9_L1.18, H2.11_L1.18, H2.12_L1.18, H2.71_L1.18, H2.75_L1.18, H2.90 L1.18, H2.91_L1.18, H2.118_L1.18, H2.119_L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H1.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2.

In some embodiments, the CLDN6 binding domain comprises a VH/VL pair selected from the group consisting of: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9, L1.4_H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1_L1.16, H1.2_L1.16, H1.3_L1.16, H1.4 L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1_L1.16, H2.2_L1.16, H2.3_L1.16, H2.4 L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5 L1.18, H1.6_L1.18, H1.7_L1.18, H1.8_L1.18, H1.9_L1.18, H1.19_L1.18, H1.22_L1.18, H1.24_L1.18, H2_L1.18, H2.1_L1.18, H2.2_L1.18, H2.3_L1.18, H2.4_L1.18, H2.5 L1.18, H2.6_L1.18, H2.7_L1.18, H2.8_L1.18, H2.9_L1.18, H2.11_L1.18, H2.12_L1.18, H2.71_L1.18, H2.75_L1.18, H2.90_L1.18, H2.91_L1.18, H2.118_L1.18, H2.119 L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H1.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2.

In certain embodiments, the CLDN6 binding domain comprises a VH/VL pair selected from the group consisting of: H1.9_L1.187, H1.24_L1.187, H2.91_L1.187 and H1.9_L1.187.

In some embodiments of the heterodimeric antibody, the anti-CD3 scFv comprises a VH/VL pair selected from the group consisting of H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31.

In some embodiments of the heterodimeric antibody, the scFv linker is a charged scFv linker.

In some embodiments, the first and second Fc domains are variant Fc domains. In some embodiments, the first and second Fc domains comprise a set of heterodimerization variants selected from the group consisting of those depicted in FIGS. 1A-1E. In some embodiments, the set of heterodimerization variants selected is from the group consisting of S364K/E357Q:L368D/K370S; S364K:L368D/K370S; S364K:L368E/K370S; D401K:T411E/K360E/Q362E; and T366W:T366S/L368A/Y407V, wherein numbering is according to EU numbering.

In some embodiments, the first and second monomers further comprise one or more ablation variants. In some embodiments, the one or more ablation variants are E233P/L234V/L235A/G236del/S267K, wherein numbering is according to EU numbering.

In exemplary embodiments, one of the first or second monomer comprises one or more pI variants. In some embodiments, the one or more pI variants are N208D/Q295E/N384D/Q418E/N421D, wherein numbering is according to EU numbering.

In exemplary embodiments of the heterodimeric antibody, the first monomer comprises amino acid variants S364K/E357Q/E233P/L234V/L235A/G236del/S267K, the second monomer comprises amino acid variants L368D/K370S/N208D/Q295E/N384D/Q418E/N421D/E233P/L234V/L235A/G236del/S267K, and wherein numbering is according to EU numbering.

In some embodiments, the first and second monomers each further comprise amino acid variants 428/434S, wherein numbering is according to EU numbering.

In another aspect, provided herein is a heterodimeric antibody comprising: a) a first monomer comprising, from N-terminal to C-terminal, a scFv-linker-CH2-CH3, wherein scFv is an anti-CD3 scFv and CH2-CH3 is a first Fc domain; b) a second monomer comprising, from N-terminal to C-terminal, a VH-CH1-hinge-CH2-CH3, wherein CH2-CH3 is a second Fc domain; and c) a light chain comprising VL-CL. The first variant Fc domain comprises amino acid variants S364K/E357Q, the second variant Fc domain comprises amino acid variants L368D/K370S, the first and second variant Fc domains each comprises amino acid variants E233P/L234V/L235A/G236del/S267K, and the CH1-hinge-CH2-CH3 of the second monomer comprises amino acid variants N208D/Q295E/N384D/Q418E/N421D (EU numbering). Further, the VH and VL form an CLDN6 binding domain comprising the variable heavy domain and the variable light domain, respectively, of an CLDN6 binding domain selected from H1.9_L1.187, H1.24_L1.187, H2.91_L1.187 and H1.9_L1.187; and the anti-CD3 scFv comprises the variable heavy domain and the variable light domain of a CD3 binding domain selected from H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31.

In some embodiments, the first and second variant Fc domains each further comprise amino acid variants 428/434S, wherein numbering is according to EU numbering.

In another aspect, provided herein is a heterodimeric antibody comprising: a) a first monomer, b) a second monomer, and c) a common light chain. The first monomer comprises, from N-terminal to C-terminal, a VH1-CH1-linker 1-scFv-linker 2-CH2-CH3, wherein VH1 is a first variable heavy domain, scFv is an anti-CD3 scFv, linker 1 and linker 2 are a first domain linker and second domain linker, respectively, and CH2-CH3 is a first Fc domain. The second monomer comprises, from N-terminal to C-terminal, a VH2-CH1-hinge-CH2-CH3, wherein VH2 is a second variable heavy domain and CH2-CH3 is a second Fc domain; and c) a common light chain comprising a variable light domain. The first variable heavy domain and the variable light domain form a first CLDN6 ABD, and the second variable heavy domain and the variable light domain form a second CLDN6 ABD.

In some embodiments, the first and second CLDN6 binding domains each comprise a set of 6 CDRs (vhCDR1, vhCDR2, vhCDR3, vlCDR1, vlCDR2 and vlCDR3) from a VH/VL pair selected from the group consisting of: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9, L1.4_H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1_L1.16, H1.2 L1.16, H1.3_L1.16, H1.4_L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1_L1.16, H2.2 L1.16, H2.3_L1.16, H2.4_L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5_L1.18, H1.6_L1.18, H1.7_L1.18, H1.8_L1.18, H1.9 L1.18, H1.19_L1.18, H1.22_L1.18, H1.24_L1.18, H2_L1.18, H2.1_L1.18, H2.2_L1.18, H2.3_L1.18, H2.4_L1.18, H2.5_L1.18, H2.6_L1.18, H2.7_L1.18, H2.8_L1.18, H2.9 L1.18, H2.11_L1.18, H2.12_L1.18, H2.71_L1.18, H2.75_L1.18, H2.90_L1.18, H2.91 L1.18, H2.118_L1.18, H2.119_L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H1.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2.

In exemplary embodiments, each of the first and second CLDN6 binding domains comprise a VH/VL pair selected from the group consisting of: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9_L1.4 H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1_L1.16, H1.2 L1.16, H1.3_L1.16, H1.4_L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1_L1.16, H2.2 L1.16, H2.3_L1.16, H2.4_L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5_L1.18, H1.6_L1.18, H1.7_L1.18, H1.8_L1.18, H1.9 L1.18, H1.19_L1.18, H1.22_L1.18, H1.24_L1.18, H2_L1.18, H2.1_L1.18, H2.2_L1.18, H2.3_L1.18, H2.4_L1.18, H2.5_L1.18, H2.6_L1.18, H2.7_L1.18, H2.8_L1.18, H2.9 L1.18, H2.11_L1.18, H2.12_L1.18, H2.71_L1.18, H2.75_L1.18, H2.90_L1.18, H2.91 L1.18, H2.118_L1.18, H2.119_L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H1.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2.

In some embodiments, the VH/VL pairs are selected from the group consisting of H1.9_L1.187, H1.24_L1.187, H2.91_L1.187 and H1.9_L1.187.

In some embodiments, the scFv comprises a set of 6 CDRs (vhCDR1, vhCDR2, vhCDR3, vlCDR1, vlCDR2 and vlCDR3) from VH/VL pairs selected from the group consisting of: H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31. In exemplary embodiments, the scFv comprises the variable heavy domain and variable light domain of any of the following CD3 binding domains: H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31.

In some embodiments of the heterodimeric antibody, the scFv linker is a charged scFv linker. In some embodiments, the scFv linker is a charged scFv linker having the amino acid sequence (GKPGS)$_4$ (SEQ ID NO: 1).

In some embodiments, the first and second Fc domains are variant Fc domains. In some embodiments, the first and second Fc domains comprise a set of heterodimerization variants selected from the group consisting of those depicted in FIGS. 1A-1E. In some embodiments, the set of heterodimerization variants selected is from the group consisting of S364K/E357Q:L368D/K370S; S364K:L368D/K370S; S364K:L368E/K370S; D401K:T411E/K360E/Q362E; and T366W:T366S/L368A/Y407V, wherein numbering is according to EU numbering.

In some embodiments, the first and second monomers further comprise one or more ablation variants. In some embodiments, the one or more ablation variants are E233P/L234V/L235A/G236del/S267K, wherein numbering is according to EU numbering.

In exemplary embodiments, one of the first or second monomers comprises one or more pI variants. In some embodiments, the one or more pI variants are N208D/Q295E/N384D/Q418E/N421D, wherein numbering is according to EU numbering.

In exemplary embodiments of the heterodimeric antibody, the first monomer comprises amino acid variants S364K/E357Q/E233P/L234V/L235A/G236del/S267K, the second monomer comprises amino acid variants L368D/K370S/N208D/Q295E/N384D/Q418E/N421D/E233P/L234V/L235A/G236del/S267K, and wherein numbering is according to EU numbering.

In some embodiments, the first and second monomers each further comprise amino acid variants 428/434S, wherein numbering is according to EU numbering.

In another aspect, provided herein is heterodimeric antibody comprising: a) a first monomer, b) a second monomer, and c) a common light chain. The first monomer comprises, from N-terminal to C-terminal, a VH1-CH1-linker 1-scFv-linker 2-CH2-CH3, wherein scFv is an anti-CD3 scFv and CH2-CH3 is a first Fc domain. The second monomer comprises, from N-terminal to C-terminal, a VH1-CH1-hinge-CH2-CH3, wherein CH2-CH3 is a second Fc domain. The common light chain comprising VL-CL. The first variant Fc domain comprises amino acid variants S364K/E357Q, the second variant Fc domain comprises amino acid variants L368D/K370S, the first and second variant Fc domains each comprises amino acid variants E233P/L234V/L235A/G236del/S267K, and the CH1-hinge-CH2-CH3 of the second monomer comprises amino acid variants N208D/Q295E/N384D/Q418E/N421D (EU numbering). The VH and VL comprise the variable heavy domain and the variable light domain of a CLDN6 ABD selected from H1.9_L1.187, H1.24_L1.187, H2.91_L1.187 and H1.9_L1.187; and the anti-CD3 scFv comprises the variable heavy domain and the variable light domain of a CD3 binding domain selected from H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31.

Also provided herein are nucleic acid compositions comprising nucleic acids encoding the antibodies described herein, expression vector compositions that include such nucleic acids, host cells for making the antibodies that comprise the expression vector compositions, and methods of making the antibodies.

BRIEF DESCRIPTION OF THE DRAWINGS

FIGS. 1A-1E depict useful pairs of Fc heterodimerization variant sets (including skew and pI variants) that lead to Fc heterodimerization. There are variants for which there are no corresponding "monomer 2" variants; these are pI variants which can be used alone on either monomer.

FIG. 2 depicts a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein.)

FIG. 3 depicts useful ablation variants that ablate FcγR binding (sometimes referred to as "knock outs" or "KO" variants). Generally, ablation variants are found on both monomers, although in some cases they may be on only one monomer FIG. 4 depicts particularly useful embodiments of "non-Fv" components of the invention.

FIG. 5 depicts a number of charged scFv linkers that find use in increasing or decreasing the pI of the subject heterodimeric bsAbs that utilize one or more scFv as a component, as described herein. The (+H) positive linker finds particular use herein, particularly with anti-CD3 $V_L$ and $V_H$ sequences shown herein. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs. Such charged scFv linkers can be used in any of the subject antibody formats disclosed herein that include scFvs (e.g., 1+1 Fab-scFv-Fc and 2+1 Fab$_2$-scFv-Fc formats).

FIG. 6 depicts a number of exemplary domain linkers. In some embodiments, these linkers find use linking a single-chain Fv to an Fc chain. In some embodiments, these linkers may be combined. For example, a GGGGS linker (SEQ ID NO: 5) may be combined with a "half hinge" linker.

FIG. 7A-7D depicts the sequences of several useful 1+1 Fab-scFv-Fc bispecific antibody format heavy chain backbones based on human IgG1, without the Fv sequences (e.g. the scFv and the VH for the Fab side). Backbone 1 is based on human IgG1 (356E/358M allotype), and includes the S364K/E357Q:L368D/K370S skew variants, C220S on the chain with the S364K/E357Q skew variants, the N208D/Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes S364K:L368D/K370S skew variants, C220S on the chain with the S364K skew variant, the N208D/Q295E/N384D/Q418E/N421D pI variants on the chain with L368D/K370S skew variants, and the E233P/L234V/L235A/G236del/S267K ablation variants on both chains. Backbone 3 is based on human IgG1 (356E/358M allotype), and includes S364K:L368E/K370S skew variants, C220S on the chain with the S364K skew variant, the N208D/Q295E/N384D/Q418E/N421D pI variants on the chain with L368E/K370S skew variants and the E233P/L234V/L235A/G236del/S267K ablation variants on both chains. Backbone 4 is based on human IgG1 (356E/358M allotype), and includes D401K:K360E/Q362E/T411E skew variants, C220S on the chain with the D401K skew variant, the N208D/Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes S364K/E357Q:L368D/K370S skew variants, C220S on the chain with the S364K/E357Q skew variants, the N208D/Q295E/N384D/Q418E/N421D pI variants on the chain with L368D/K370S skew variants and the E233P/L234V/L235A/G236del/S267K ablation variants on both chains. Backbone 6 is based on human IgG1 (356E/358M allotype), and includes S364K/E357Q:L368D/K370S skew variants, C220S on the chain with the S364K/E357Q skew variants, N208D/Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Backbone 8 is based on human IgG4, and includes the S364K/E357Q:L368D/K370S skew variants, the N208D/Q295E/N384D/Q418E/N421D pI variants on the chain with L368D/K370S skew variants, as well as a S228P (EU numbering, this is S241P in Kabat) variant on both chains that ablates Fab arm exchange as is known in the art. Backbone 9 is based on human IgG2, and includes the S364K/E357Q:L368D/K370S skew variants, the N208D/Q295E/N384D/Q418E/N421D pI variants on the chain with L368D/K370S skew variants. Backbone 10 is based on human IgG2, and includes the S364K/E357Q:L368D/K370S skew variants, the N208D/Q295E/N384D/Q418E/N421D pI variants on the chain with L368D/K370S skew variants as well as a S267K variant on both chains. Backbone 11 is identical to backbone 1, except it includes M428L/N434S Xtend mutations. Backbone 12 is based on human IgG1 (356E/358M allotype), and includes S364K/E357Q:L368D/K370S skew variants, C220S and the P217R/P229R/N276K pI variants on the chain with S364K/E357Q skew variants and the E233P/L234V/L235A/G236del/S267K ablation variants on both chains. Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIGS. 8A-8C depict the sequences of several useful 2+1 Fab$_2$-scFv-Fc bispecific antibody format heavy chain backbones based on human IgG1, without the Fv sequences (e.g. the scFv and the VH for the Fab side). Backbone 1 is based on human IgG1 (356E/358M allotype), and includes the S364K/E357Q:L368D/K370S skew variants, the N208D/Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes S364K:L368D/K370S skew variants, the N208D/Q295E/N384D/Q418E/N421D pI variants on the chain with L368D/K370S skew variants, and the E233P/L234V/L235A/G236del/S267K ablation variants on both chains. Backbone 3 is based on human IgG1 (356E/358M allotype), and includes S364K:L368E/K370S skew variants, the N208D/Q295E/N384D/Q418E/N421D pI variants on the chain with L368E/K370S skew variants and the E233P/L234V/L235A/G236del/S267K ablation variants on both chains. Backbone 4 is based on human IgG1 (356E/358M allotype), and includes D401K:K360E/Q362E/T411E skew variants, the N208D/Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes S364K/E357Q:L368D/K370S skew variants, the N208D/Q295E/N384D/Q418E/N421D pI variants on the chain with L368D/K370S skew variants and the E233P/L234V/L235A/G236del/S267K ablation variants on both chains. Backbone 6 is based on human IgG1 (356E/358M allotype), and includes S364K/E357Q:L368D/K370S skew variants, N208D/Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Backbone 8 is identical to backbone 1, except it includes M428L/N434S Xtend mutations. Backbone 9 is based on human IgG1 (356E/358M allotype), and includes S364K/E357Q:L368D/K370S skew variants, the P217R/P229R/N276K pI variants on the chain with S364K/E357Q skew variants and the E233P/L234V/L235A/G236del/S267K ablation variants on both chains. Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 9 depicts the sequences of several useful constant light domain backbones based on human IgG1, without the Fv sequences (e.g. the scFv or the Fab). Included herein are constant light backbone sequences that are 90, 95, 98 and 99% identical (as defined herein) to the recited sequences, and/or contain from 1, 2, 3, 4, 5, 6, 7, 8, 9 or 10 additional amino acid modifications.

FIG. 10A-10F depicts sequences for exemplary anti-CD3 scFvs suitable for use in the bispecific antibodies of the invention. The CDRs are underlined, the scFv linker is double underlined (in the sequences, the scFv linker is a positively charged scFv (GKPGS)$_4$ linker (SEQ ID NO: 1), although as will be appreciated by those in the art, this linker can be replaced by other linkers, including uncharged or negatively charged linkers, some of which are depicted in FIG. 5), and the slashes indicate the border(s) of the variable domains. In addition, the naming convention illustrates the orientation of the scFv from N- to C-terminus. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 11 depicts the antigen sequences for a number of antigens of use in the invention, including both human and cyno, to facilitate the development of antigen binding domains that bind to both for ease of clinical development.

FIG. 12 depicts alignment of human CLDN6 and CLDN9 sequences and highlights the 3 differences in their respective extracellular loops. FIG. 12 discloses SEQ ID NOS 173-174, respectively, in order of appearance.

FIG. 13 depicts the variable heavy and variable light chain sequences for exemplary murine CLDN6 binding domain referred to herein as mC6-30 as well as sequences for XENP34243, a bivalent IgG1 mAb based on mC6-30 and with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 14 depicts the variable heavy and variable light chain sequences for humanized C6-30 variants. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Further, as for all the sequences in the Figures, these VH and VL sequences can be used either in a scFv format or in a Fab format. Furthermore, each of the variable heavy domains depicted herein can be paired with any other αCLDN6 variable light domain; and each of the variable light domains depicted herein can be paired with any other αCLDN6 variable heavy domain.

FIG. 15A-15J depicts the variable heavy and variable light chain sequences for C6-30 variants engineered for reduced degradation (e.g. aspartic acid isomerization and deamidation) liability, enhanced selectivity for CLDN6, and/or modulated CLDN6 binding affinity. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Further, as for all the sequences in the Figures, these $V_H$ and $V_L$ sequences can be used either in a scFv format or in a Fab format. Furthermore, each of the variable heavy domains depicted herein can be paired with any other αCLDN6 variable light domain; and each of the variable light domains depicted herein can be paired with any other αCLDN6 variable heavy domain.

FIGS. 16A-16W depict illustrative C6-30[CLDN6] variants (parental humanized variants and further engineered variants) formatted as bivalent anti-CLDN6 mAb and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 17A depicts the "1+1 Fab-scFv-Fc" format, with a first Fab arm binding CLDN6 and a second scFv arm binding CD3. FIG. 17B depicts the "2+1 Fab$_2$-scFv-Fc" format, with a first Fab arm binding CLDN6 and a second Fab-scFv arm, wherein the Fab binds CLDN6 and the scFv binds CD3.

FIG. 18 depicts sequences of a comparator CLDN6 binding domain (sequences as disclosed in U.S. Pat. No. 10,233,253) formatted as a bivalent anti-CLDN6 IgG1 mAb with E233P/L234V/L235A/G236del/S267K ablation variant (XENP26863), and formatted as a 1+1 Fab-scFv-Fc bsAb with CD3 High (XENP26849).

FIG. 19 depicts the sequences for illustrative αCLDN6× αCD3 bsAbs in the 1+1 Fab-scFv-Fc format and comprising a CD3 High scFv (H1.30_L1.47 in either the VHVL orientation or the VLVH orientation). CDRs are underlined and slashes indicate the border(s) between the variable regions and other chain components (e.g. constant region and domain linkers). It should be noted that the αCLDN6×αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum FIG. 20 depicts the sequences for illustrative αCLDN6× αCD3 bsAbs in the 1+1 Fab-scFv-Fc format and comprising a CD3 High-Int #1 scFv (H1.32_L1.47 in either the VHVL orientation or the VLVH orientation). CDRs are underlined and slashes indicate the border(s) between the variable regions and other chain components (e.g. constant region and domain linkers). It should be noted that the αCLDN6× αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum FIGS. 21A and 21B depict the sequences for illustrative αCLDN6×αCD3 bsAbs in the 2+1 Fab₂-scFv-Fc format and comprising a CD3 High scFv (H1.30_L1.47 in either the VHVL orientation or the VLVH orientation). CDRs are underlined and slashes indicate the border(s) between the variable regions and other chain components (e.g. constant region and domain linkers). It should be noted that the αCLDN6×αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIGS. 22A-22H depict the sequences for illustrative αCLDN6×αCD3 bsAbs in the 2+1 Fab₂-scFv-Fc format and comprising a CD3 High-Int #1 scFv (H1.32_L1.47 in either the VHVL orientation or the VLVH orientation). CDRs are underlined and slashes indicate the border(s) between the variable regions and other chain components (e.g. constant region and domain linkers). It should be noted that the αCLDN6×αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIGS. 23A-23F depicts binding of six murine anti-human CLDN6 bivalent mAbs designated A) C6-10, B) C6-11, C) C6-15, D) C6-21, E) C6-24, and F) C6-30 to HEK293-Trex cells that have been transfected to stably express human CLDN6, CLDN3, CLDN4, or CLDN9 as well as parental HEK293-Trex cells. Clones C6-11, C6-24, and C6-30 showed selectivity for CLDN6 over CLDN9.

FIGS. 26A-26E depicts binding of humanized variants of C6-24 in different humanization frameworks—(A) H1L1, (B) H1L2, (C) H2L1, (D) H2L2, and (E) the original mouse mAb to HEK293-Trex cells that have been transfected to stably express human CLDN6, CLDN3, CLDN4, or CLDN9 as well as parental HEK293-Trex cells. Clones C6-11, C6-24, and C6-30 showed selectivity for CLDN6 over CLDN9. Each of the humanized variants of C6-30 retained selectivity for CLDN6 over CLDN9 (as well as over CLDN3 and CLDN4).

FIG. 27 depicts variants of humanized C6-30 engineered with substitutions in the variable heavy domain to remove degradation (e.g. deamidation and aspartic acid isomerization) liabilities and their binding potency to CLDN6 and CLDN9. XENP35093 (having C6-30_H1.9_L1) maintained selectivity with minimal loss to CLDN6 binding.

FIGS. 31A and 31B depict EC50 of binding of illustrative C6-30 variants (in the context of bivalent mAbs) from the library combining the favorite variable heavy domain and variable light domain variants to HEK293E cells expressing CLDN6 or CLDN9 in A) a first and b) a second experiment. XENP26863 is a bivalent mAb based on a comparator CLDN6 binding domain. It should be noted that binding data from the experiments cannot be compared head-to-head as antigen density on the transfected cells vary between experiments. Nonetheless, several variants were enhanced in selectivity in comparison to the parental humanized clone (i.e. XENP34218_H1L1 and XENP34220_H2L1) and in comparison to comparator XENP26863.

FIG. 33 depicts EC50 of binding of illustrative C6-30 variants (in the context of bivalent mAbs) from the library combining the favorite variable heavy domain and variable light domain variants to HEK293E cells expressing CLDN6 or CLDN9. XENP26863 is a bivalent mAb based on a comparator CLDN6 binding domain. Each of the 16 combination variants were enhanced in selectivity in comparison to the parental humanized clone (i.e. XENP34218_H1L1 and XENP34220_H2L1). 10 of the 16 combination variants demonstrated enhanced selectivity in comparison to comparator XENP26863.

Figure 34A:
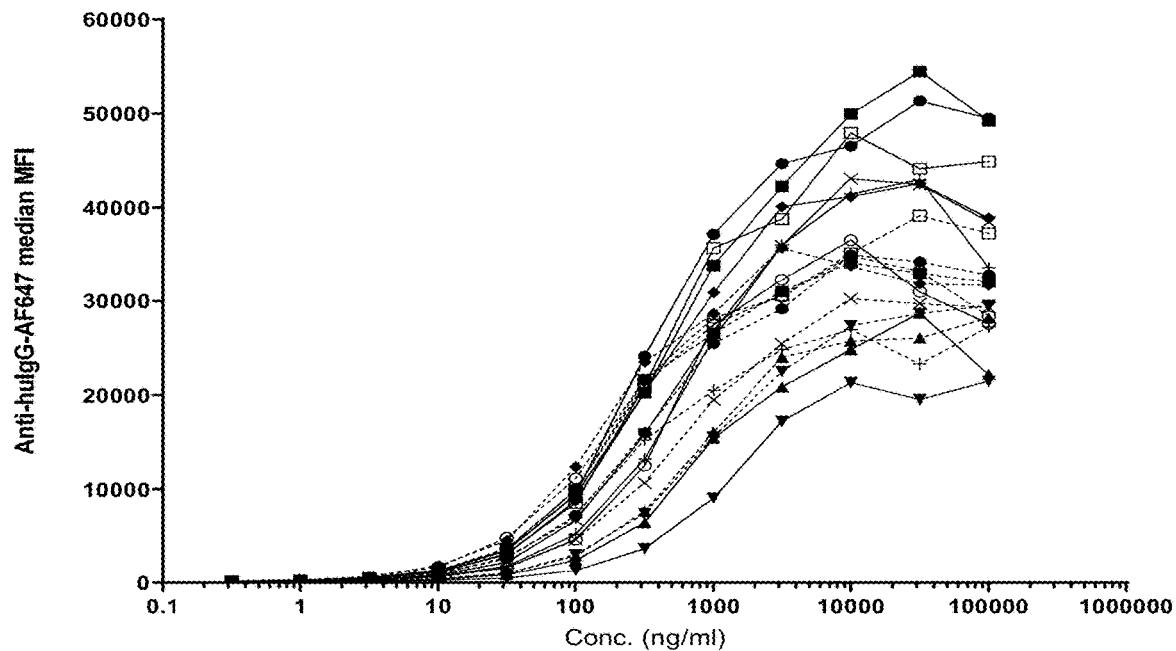
Figure 34B:
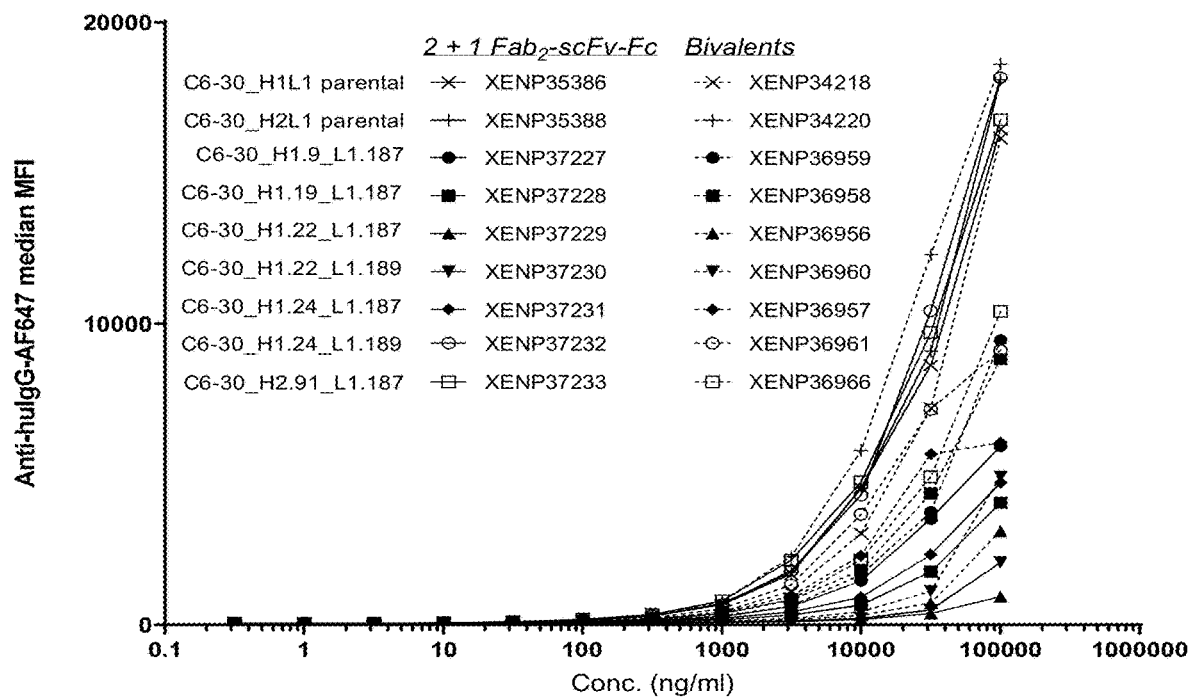

FIGS. 34A-34B depicts binding of select C6-30 variants formatted as bivalent monospecific mAbs and 2+1 Fab$_2$-scFv-Fc bsAbs to HEK293E cells expressing A) CLDN6 or B) CLDN9.

Figure 35A:
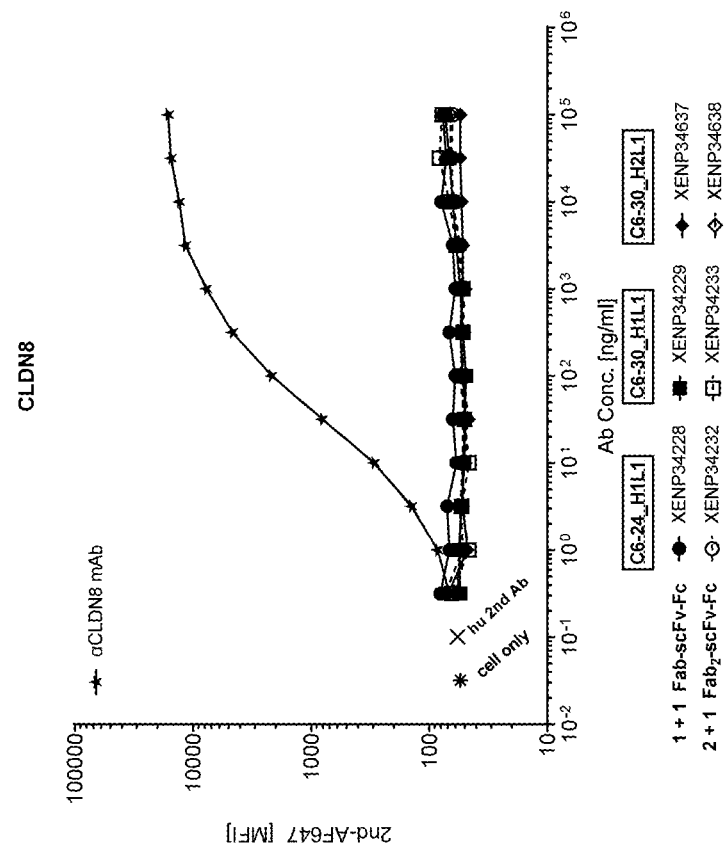
Figure 35B:
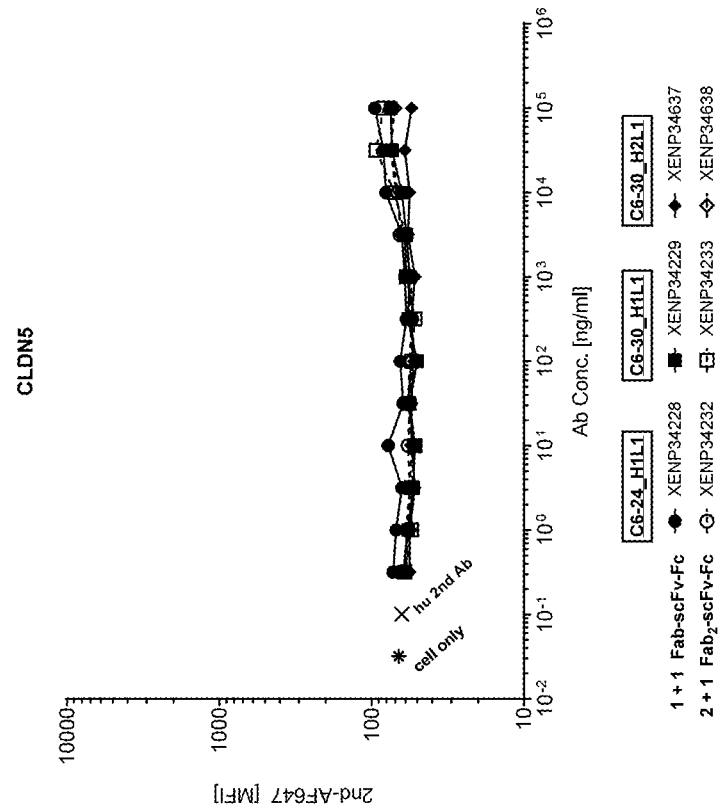
Figure 35C:
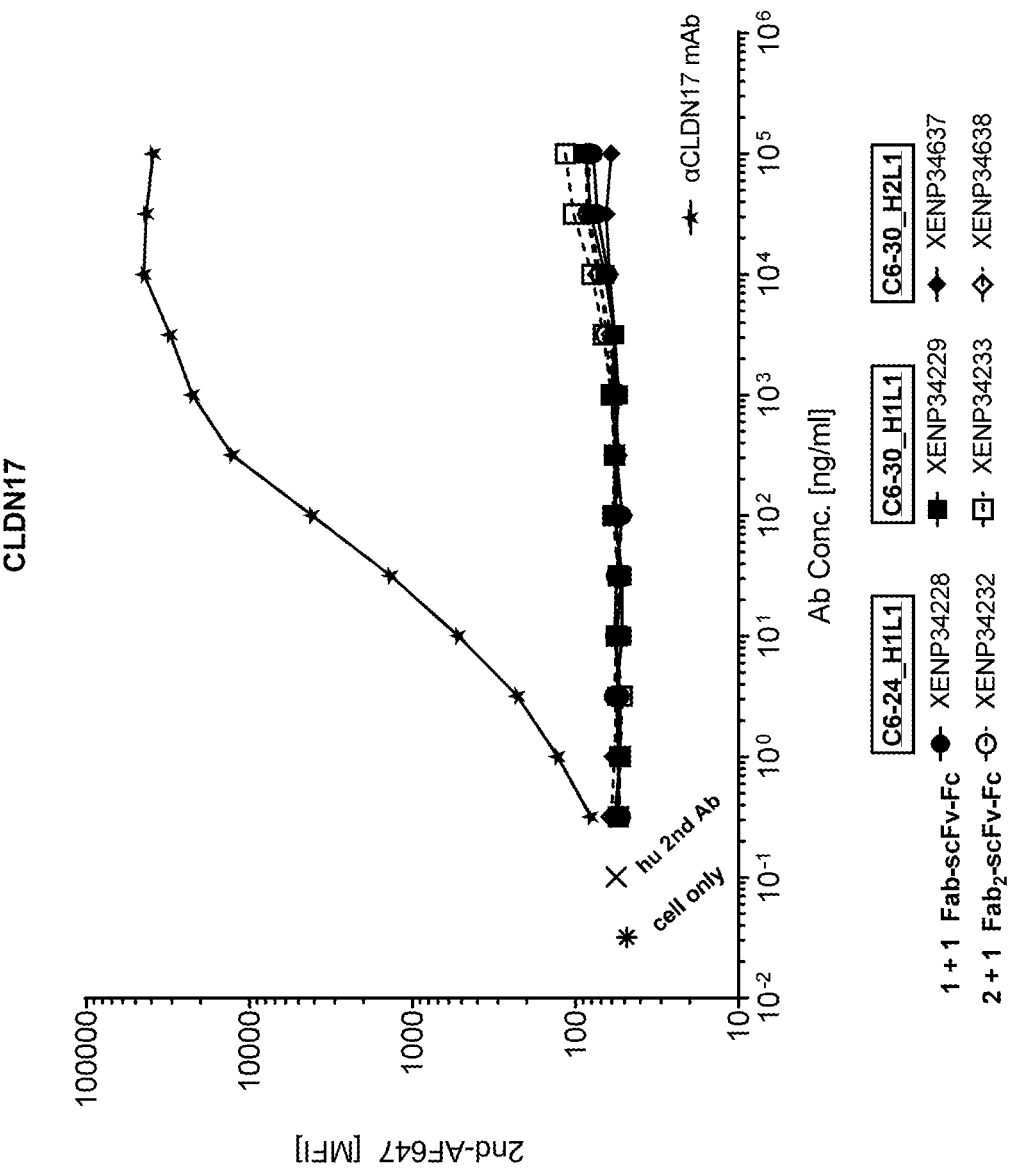

FIGS. 35A-35C depicts binding of C6-24_H1L1, C6-30_H1L1, and C6-30_H2L1 in 1+1 Fab-scFv-Fc and 2+1 Fab$_2$-scFv-Fc to cells transfected to express human A) CLDN5, B) CLDN8, and C) CLDN17. None of the clones were cross-reactive for the additional claudins investigated.

FIGS. 36A to 36J depict several formats of the present invention. The first is the 1+1 Fab-scFv-Fc format, with a first and a second anti-antigen binding domain. Additionally, mAb-Fv, mAb-scFv, Central-scFv, Central-Fv, one-armed central-scFv, one scFv-mAb, scFv-mAb and a dual scFv format are all shown. For all of the scFv domains depicted, they can be either N- to C-terminus variable heavy-(optional linker)-variable light, or the opposite. In addition, for the one-armed scFv-mAb, the scFv can be attached either to the N-terminus of a heavy chain monomer or to the N-terminus of the light chain.

Figure 37:
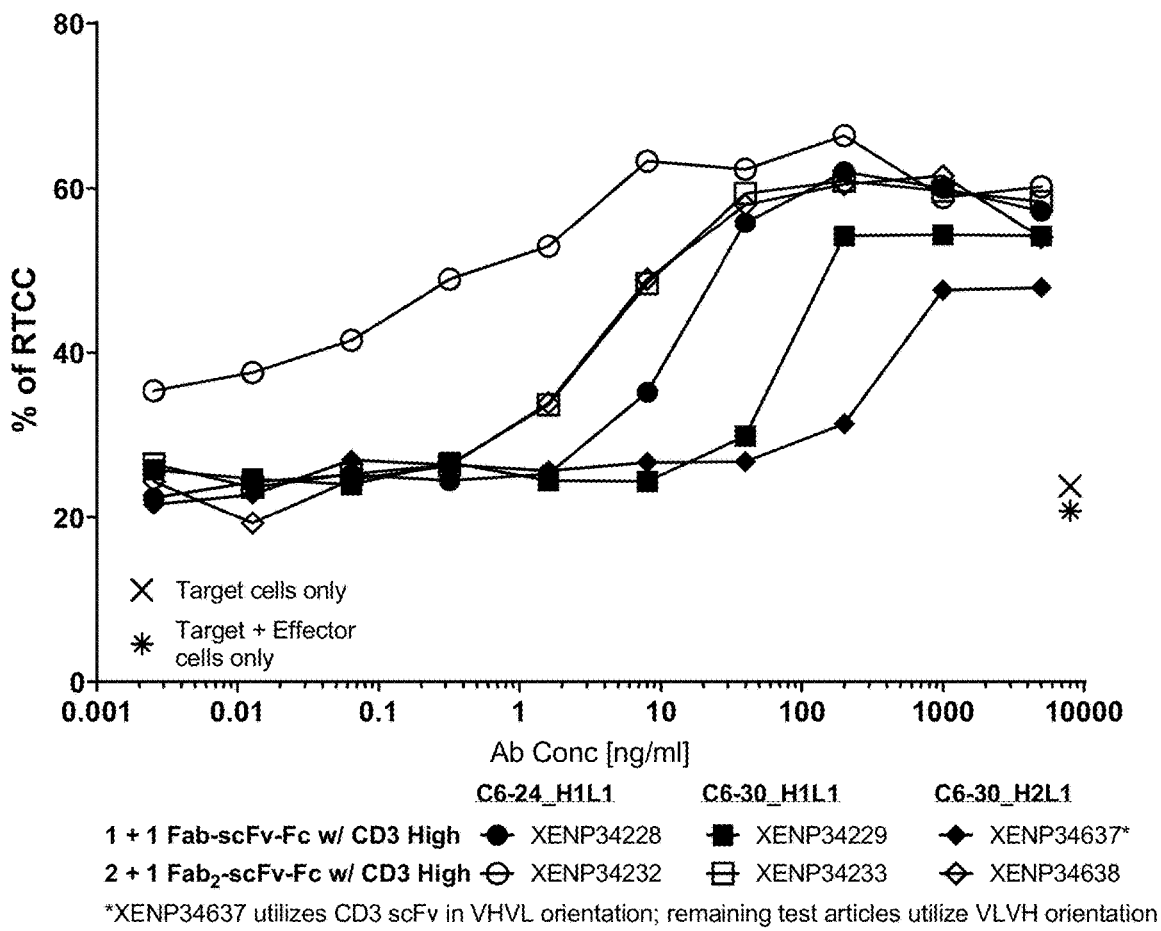

FIG. 37 depicts induction of RTCC on PA-1 (CLDN6$^{high}$) cells by C6-24_H1L1, C6-30_H1L1, and C6-30_H2L1 in 1+1 Fab-scFv-Fc and 2+1 Fab$_2$-scFv-Fc bsAbs (CD3 High). The 2+1 Fab$_2$-scFv-Fc constructs showed 20-100 fold lower EC50 in comparison to 1+1 constructs. Additionally, potency shifts between the 2+1 vs. 1+1 construct were half-log more for C6-30_H2L1 in comparison to C6-30_H1L1.

Figure 38A:
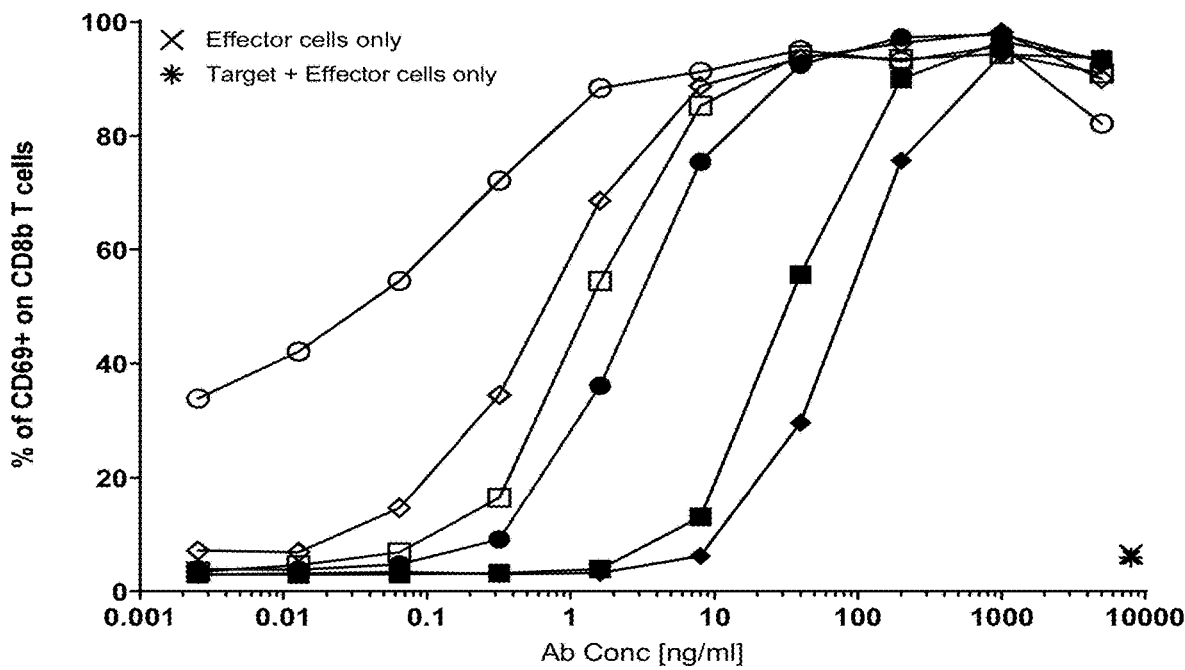
Figure 38B:
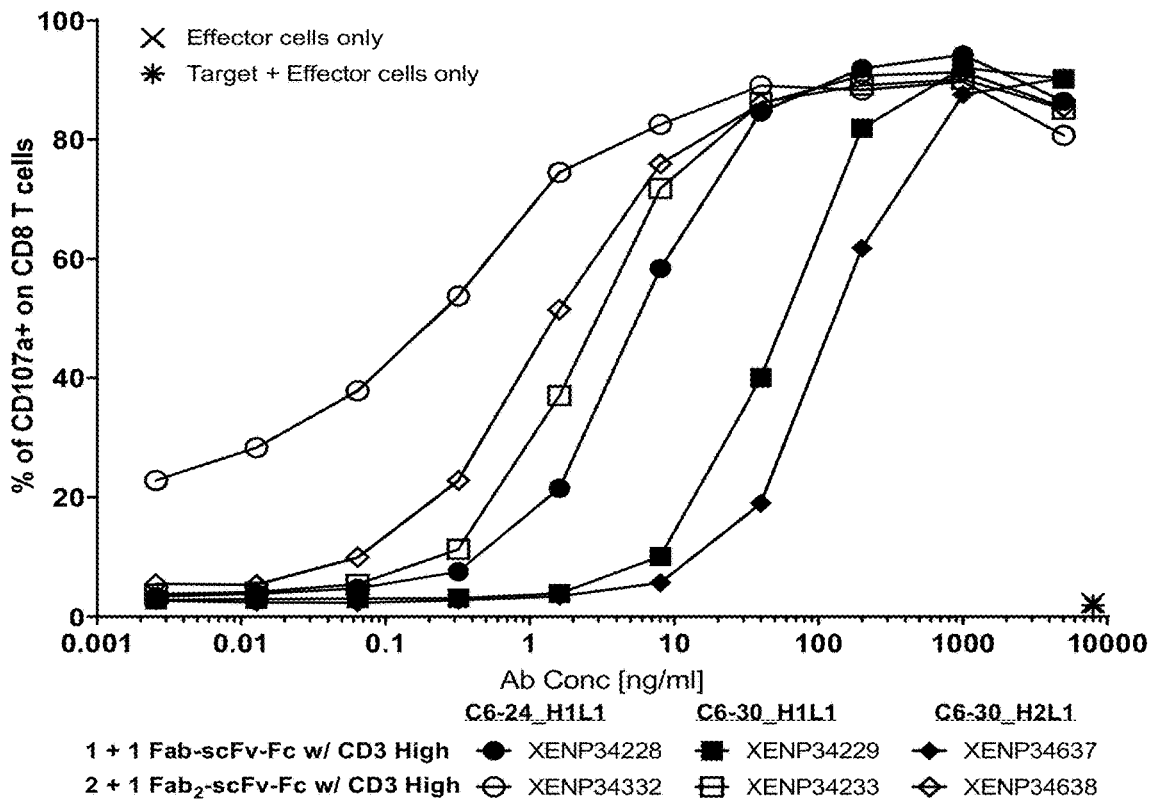

FIGS. 38A-38B depicts activation of CD8 T cells in the presence of PA-1 (CLDN6-$^{high}$) cells by C6-24_H1L1, C6-30_H1L1, and C6-30_H2L1 in 1+1 Fab-scFv-Fc and 2+1 Fab$_2$-scFv-Fc bsAbs with CD3 High as indicated by A) percentage CD8 T cells expressing CD69 and B) percentage of CD8 T cells expressing CD107a.

Figure 39B:
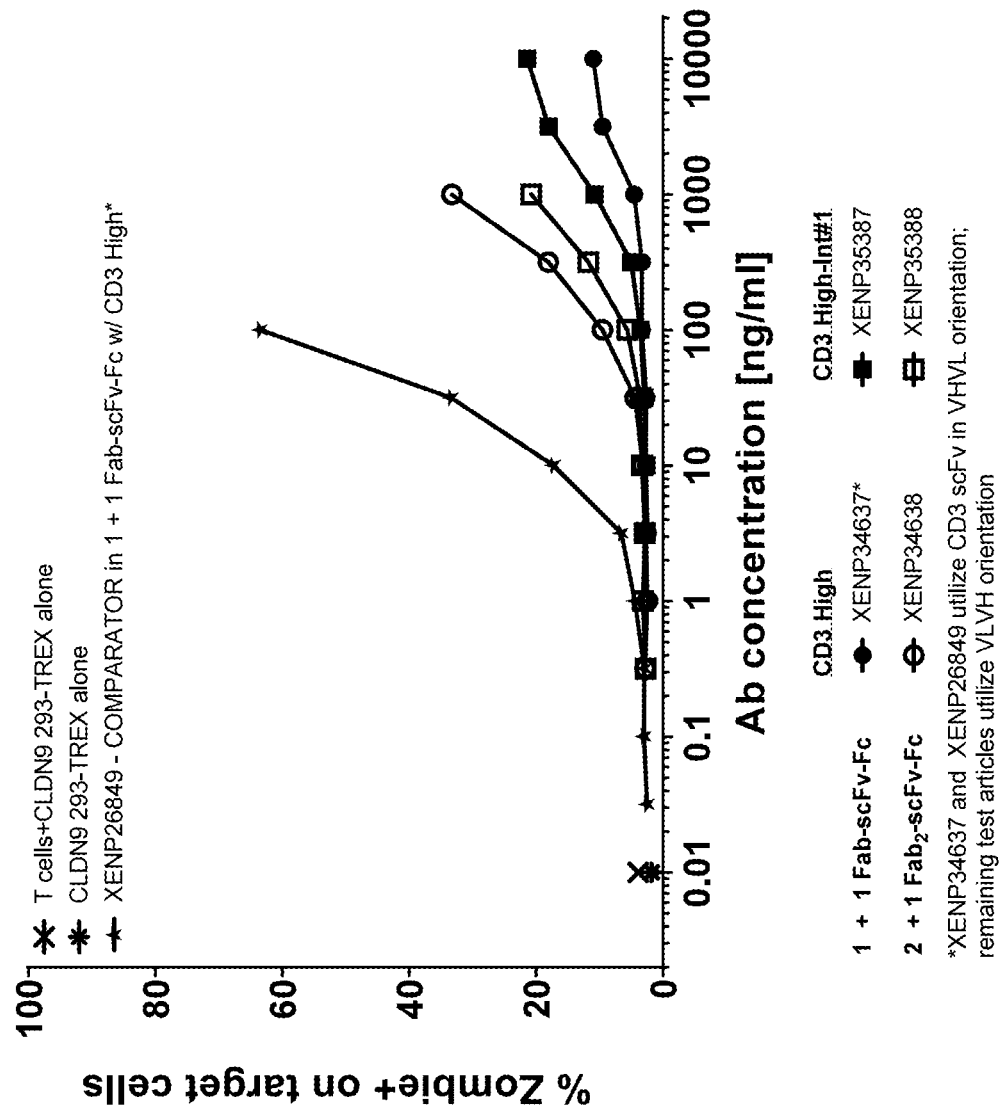

FIGS. 39A-39B depicts induction of RTCC on A) HUTU-80 (CLDN6$^{high}$) and B) CLDN293-Trex stably transfected to express CLDN9 (CLDN9$^{high}$) by C6-30 formatted as 1+1 Fab-scFv-Fc or 2+1 Fab$_2$-scFv-Fc bsAbs with CD3 High or CD3 High-Int #1. The 2+1 format enabled much more potent RTCC activity on CLDN6$^+$ cells in comparison to the 1+1 format. The bsAbs based on C6-30 demonstrated much weaker induction of RTCC on CLDN9$^+$ cells in comparison to comparator bsAb XENP26849. 2+1 Fab$_2$-scFv-Fc bsAb having the lower affinity CD3 High-Int #1 induced RTCC on off-target CLDN9$^+$ cells less potently than 2+1 bsAbs having high affinity CD3_High.

Figure 40A:
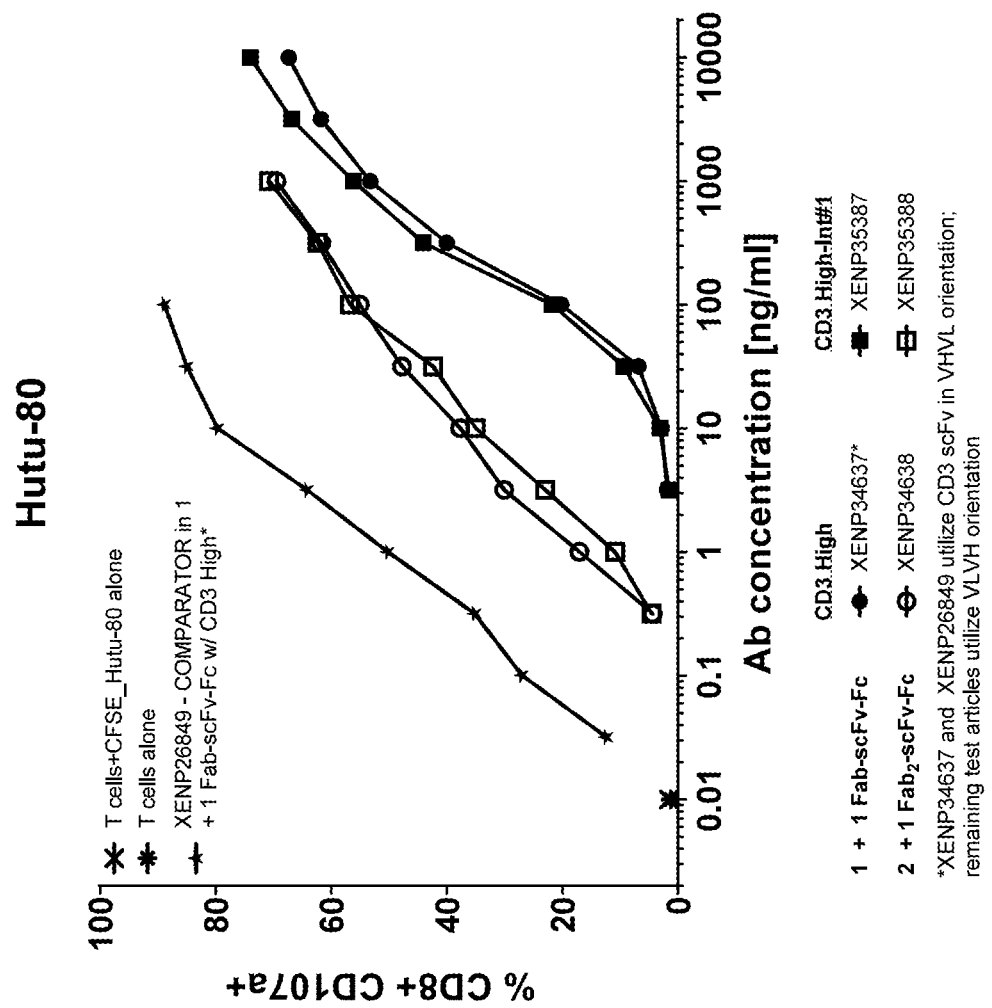
Figure 40B:
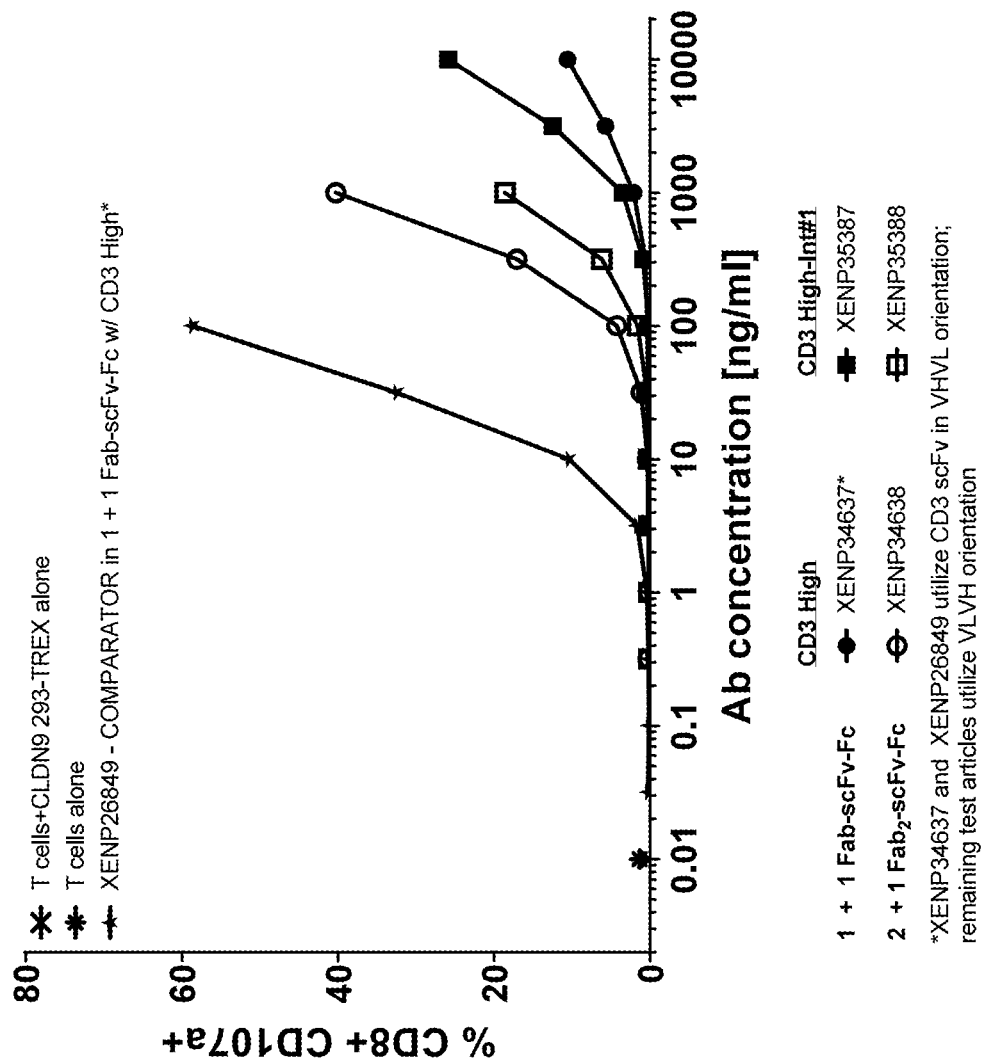
Figure 41A:
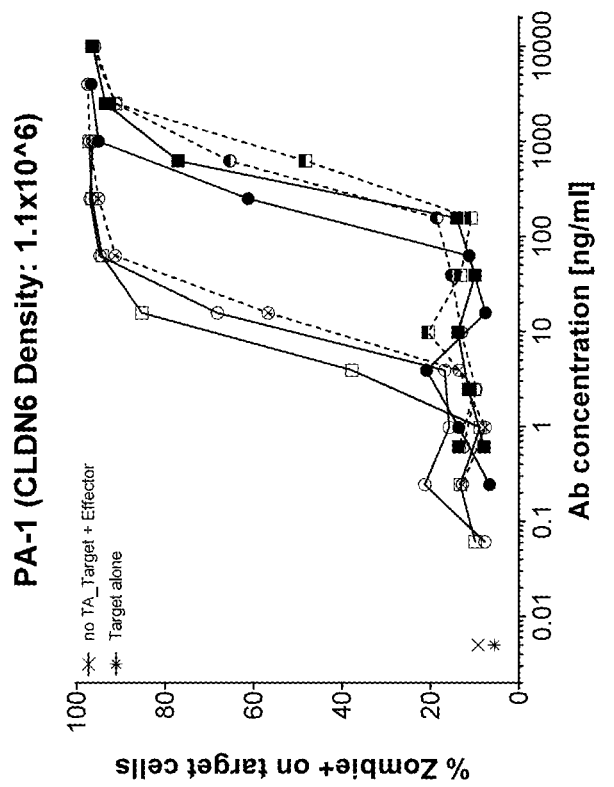
Figure 41B:
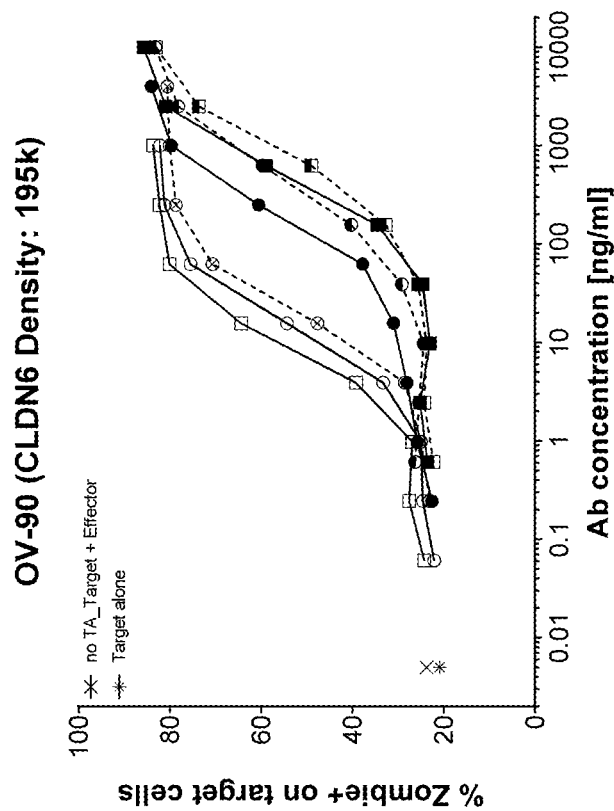
Figure 41D:
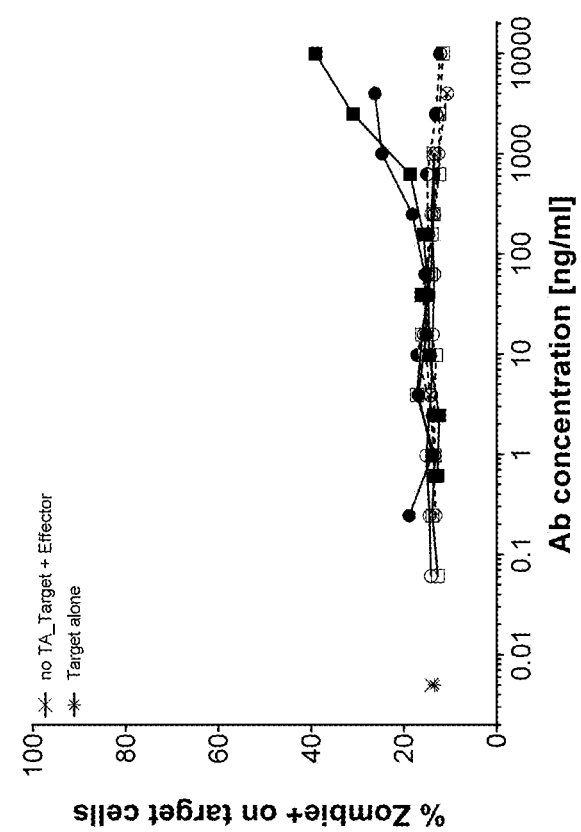
Figure 41C:
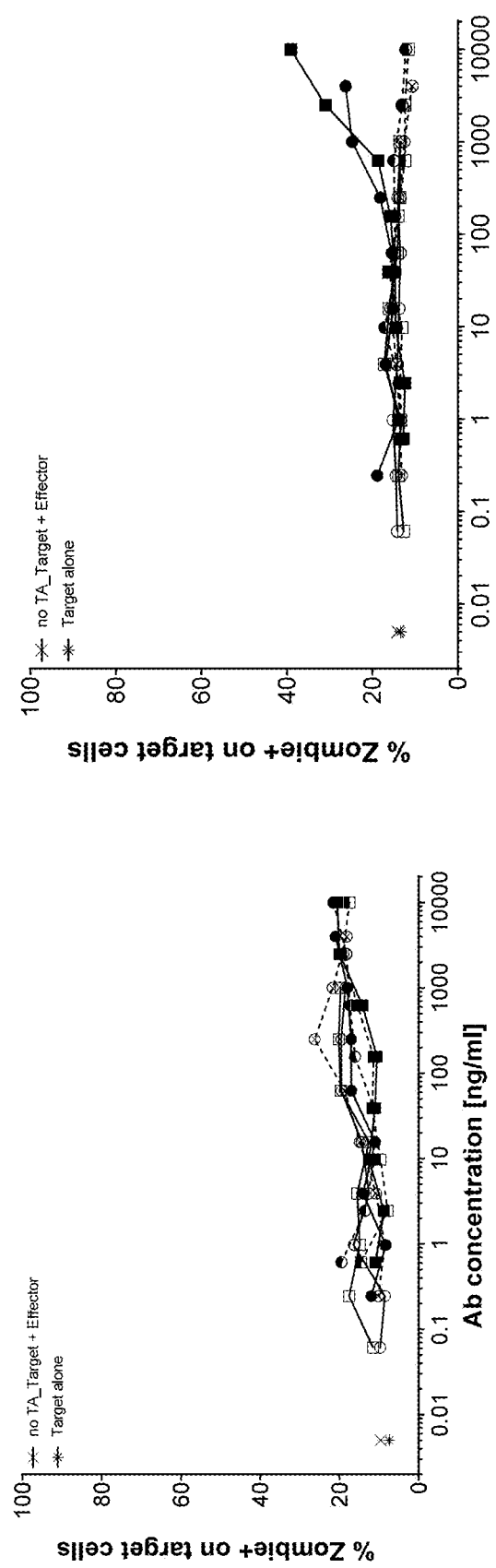
Figure 43A:
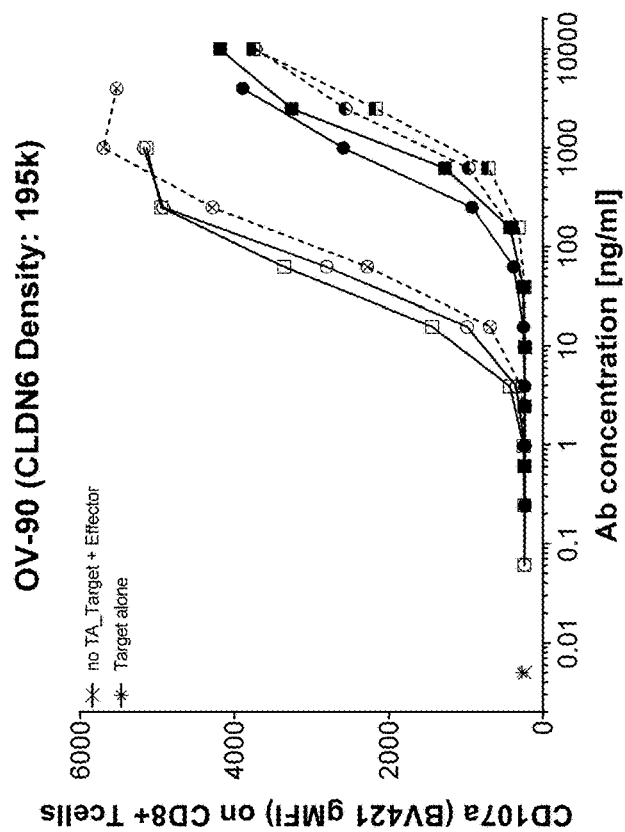
Figure 43B:
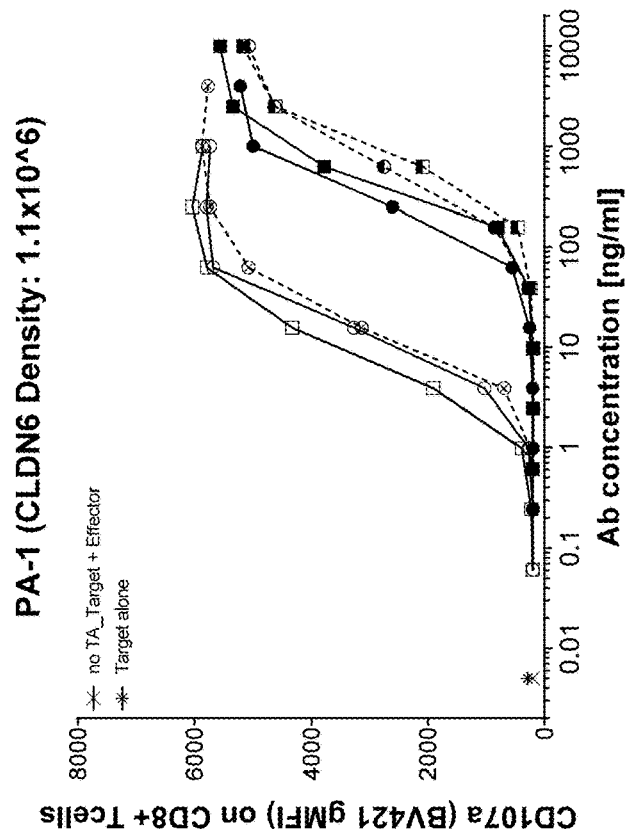

FIGS. 40A-40B depicts activation of CD8 T cells in the presence of A) HUTU-80 (CLDN6$^{high}$) and B) CLDN293-Trex stably transfected to express CLDN9 (CLDN9$^{high}$) by C6-30 formatted as 1+1 Fab-scFv-Fc or 2+1 Fab$_2$-scFv-Fc bsAbs with CD3 High or CD3 High-Int #1 (as indicated by CD107a expression).

FIGS. 41A-41D depicts induction of RTCC on A) PA-1 (1.1×10^6 CLDN6 density), B) OV-90 (195K CLDN6 density), C) NEC-8 (175K CLDN6 density), and D) COV-318 (11K CLDN6 density) cells by C6-30_H1L1 or C6-30_H2L1 in 1+1 Fab-scFv-Fc or 2+1 Fab$_2$-scFv-Fc bsAbs with CD3 High or CD3 High-Int #1. Cell killing activity correlates with CLDN6 antigen density and affinity of the CD3 binding domain.

FIG. 42 depicts EC50 of RTCC induction on PA-1 (1.1×10^6 CLDN6 density) and B) OV-90 (195K CLDN6 density) by C6-30_H1L1 or C6-30_H2L1 in 1+1 Fab-scFv-Fc or 2+1 Fab$_2$-scFv-Fc bsAbs with CD3 High or CD3 High-Int #1.

FIGS. 43A-43D depicts activation of CD8 T cells in the presence of A) PA-1 (1.1×10^6 CLDN6 density), B) OV-90 (195K CLDN6 density), C) NEC-8 (175K CLDN6 density), and D) COV-318 (11K CLDN6 density) cells by C6-30_H1L1 or C6-30_H2L1 in 1+1 Fab-scFv-Fc or 2+1 Fab$_2$-scFv-Fc bsAbs with CD3 High or CD3 High-Int #1 (as indicated by CD107a expression). T cell activation correlates with CLDN6 antigen density and affinity of the CD3 binding domain.

FIG. 44 depicts EC50 of CD8 T cell activation in the presence of A) PA-1 (1.1×10^6 CLDN6 density), B) OV-90 (195K CLDN6 density), C) NEC-8 (175K CLDN6 density), and D) COV-318 (11K CLDN6 density) cells by C6-30_H1L1 or C6-30_H2L1 in 1+1 Fab-scFv-Fc or 2+1 Fab$_2$-scFv-Fc bsAbs with CD3 High or CD3 High-Int #1 (as indicated by CD107a expression).

Figure 45A:
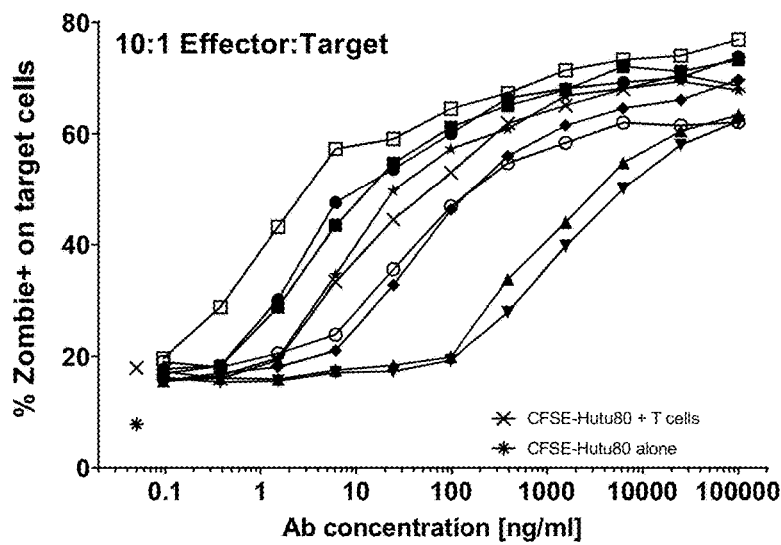
Figure 45B:
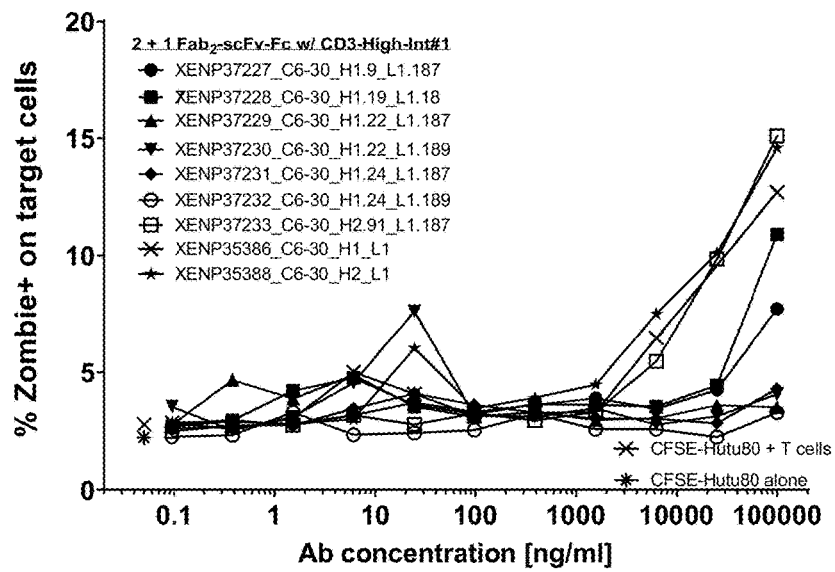

FIGS. 45A-45B depicts induction of RTCC on A) HUTU-80 (CLDN6$^{high}$) and B) CLDN293-Trex stably transfected to express CLDN9 (CLDN9$^{high}$) by C6-30 variants formatted as 2+1 Fab$_2$-scFv-Fc bsAbs with CD3 High-Int #1 at a 10:1 effector:target ratio. The bsAbs having selectivity-engineered CLDN6 binding domains demonstrated modulated activity on CLDN6$^+$ cells and/or modulated activity on CLDN9$^+$ cells in comparison to bsAbs having the parental C6-30_H1L1 and C6-30_H2L1. XENP37233 demonstrated similar activity on CLDN9$^+$ cells but significantly enhanced activity on CLDN6$^+$ cells in comparison to the parental clones. XENP37227 demonstrated reduced activity on CLDN9$^+$ cells and enhanced activity on CLDN6$^+$ cells (albeit, less enhanced in comparison to XENP37233) in comparison to the parental clones. XENP37231 demonstrated little to no activity on CLDN9$^+$ cells but slightly reduced activity on CLDN6$^+$ cells in comparison to the parental clones.

Figure 46A:
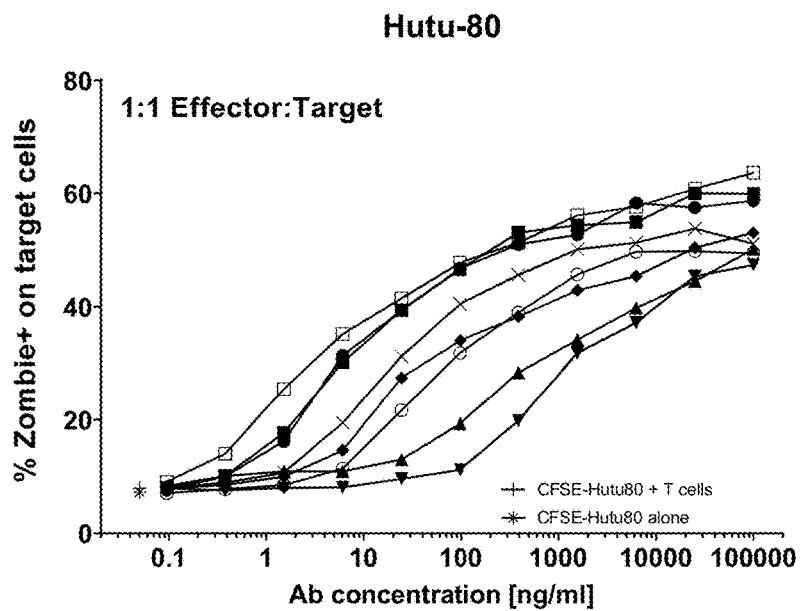
Figure 46B:
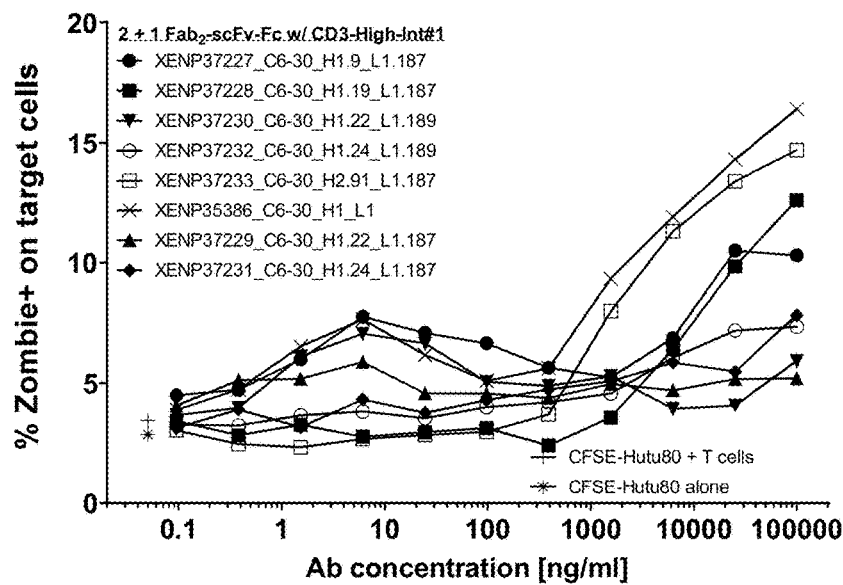

FIGS. 46A-46B depicts induction of RTCC on A) HUTU-80 (CLDN6$^{high}$) and B) CLDN293-Trex stably transfected to express CLDN9 (CLDN9$^{high}$) by C6-30 variants formatted as 2+1 Fab$_2$-scFv-Fc bsAbs with CD3 High-Int #1 at a 1:1 effector:target ratio.

Figure 47A:
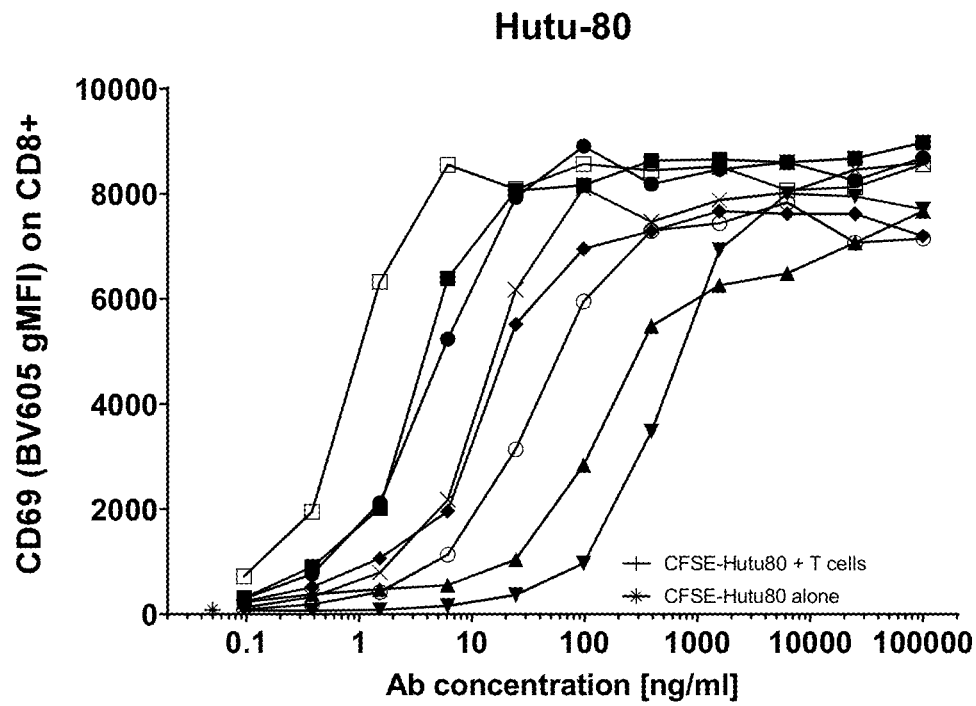
Figure 47B:
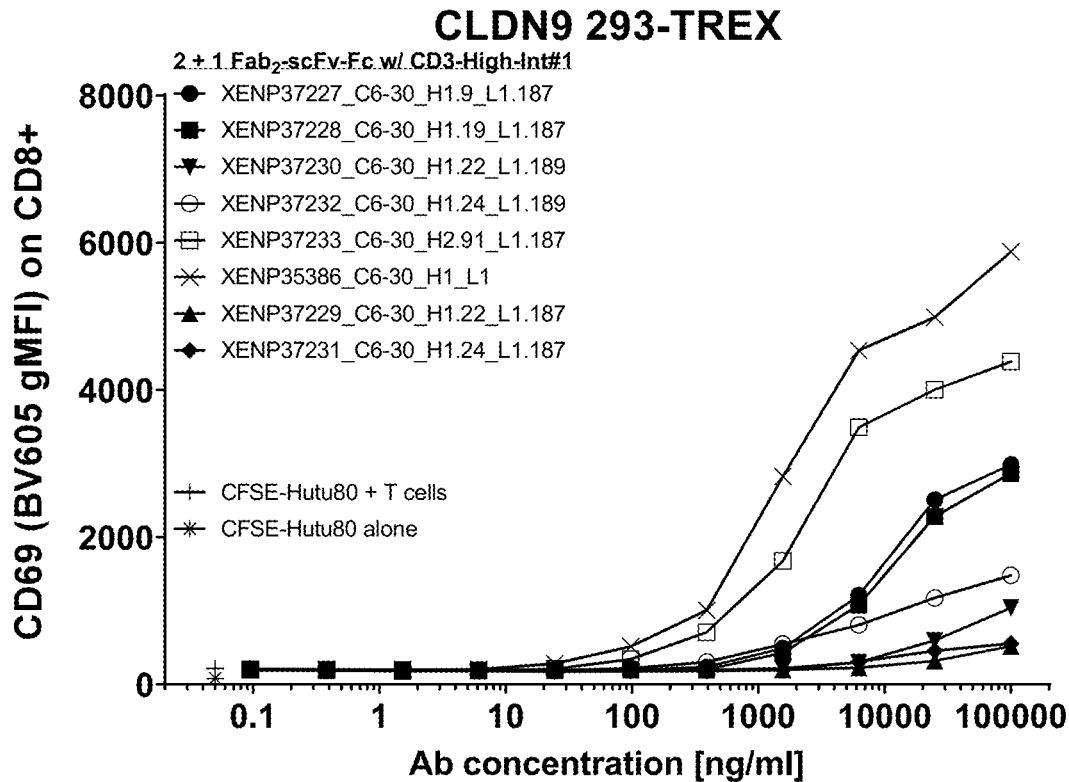

FIGS. 47A-47B depicts activation of CD8 T cells in the presence of A) HUTU-80 (CLDN6$^{high}$) and B) CLDN293-Trex stably transfected to express CLDN9 (CLDN9$^{high}$) by C6-30 formatted as 1+1 Fab-scFv-Fc or 2+1 Fab$_2$-scFv-Fc bsAbs with CD3 High or CD3 High-Int #1 (as indicated by CD69 expression).

Figure 48A:
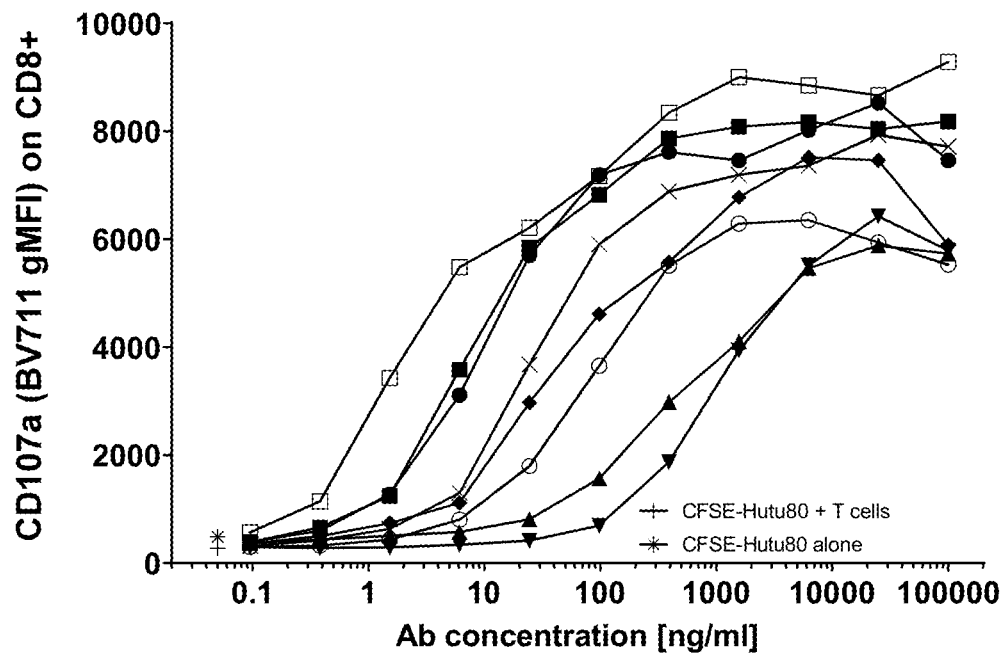
Figure 48B:
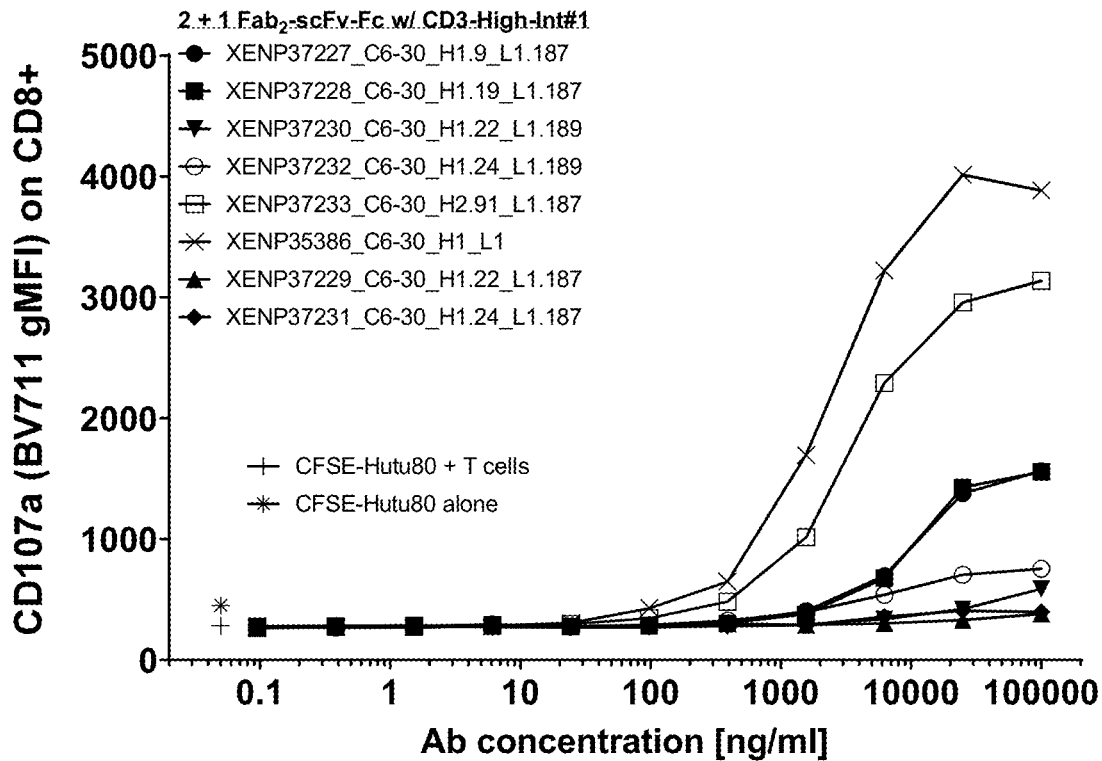

FIGS. 48A-48B depicts activation of CD8 T cells in the presence of A) HUTU-80 (CLDN6$^{high}$) and B) CLDN293-Trex stably transfected to express CLDN9 (CLDN9$^{high}$) by C6-30 formatted as 1+1 Fab-scFv-Fc or 2+1 Fab$_2$-scFv-Fc bsAbs with CD3 High or CD3 High-Int #1 (as indicated by CD107a expression).

FIGS. 49A-49B depicts IFNγ secretion by T cells in the presence of A) HUTU-80 (CLDN6$^{high}$) and B) CLDN293-Trex stably transfected to express CLDN9 (CLDN9$^{high}$) by C6-30 formatted as 1+1 Fab-scFv-Fc or 2+1 Fab$_2$-scFv-Fc bsAbs with CD3 High or CD3 High-Int #1 (as indicated by IFNγ secretion).

Figure 50A:
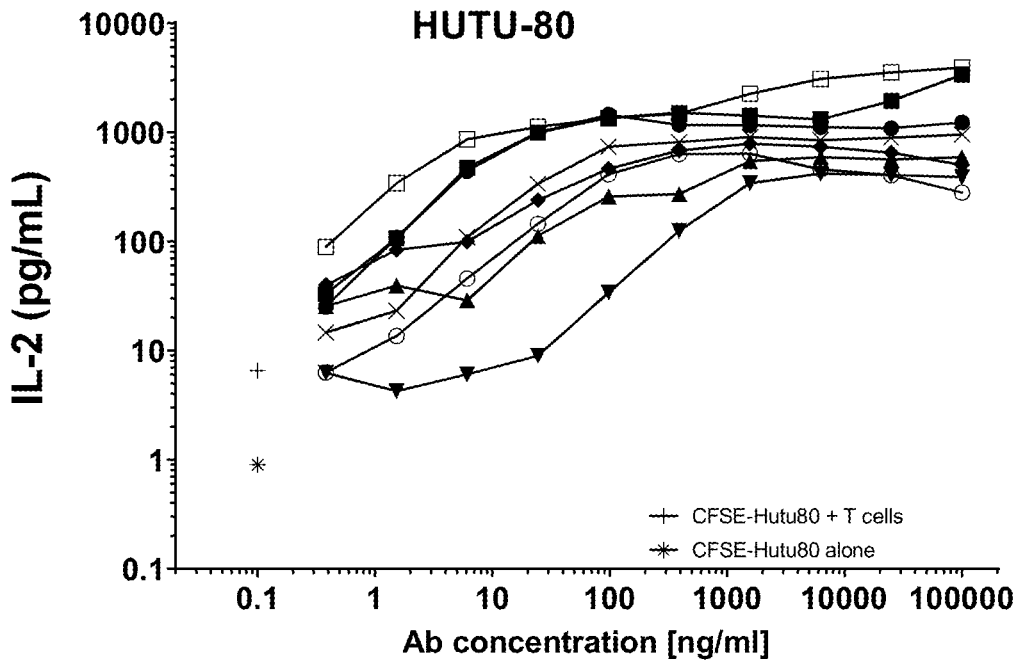
Figure 50B:
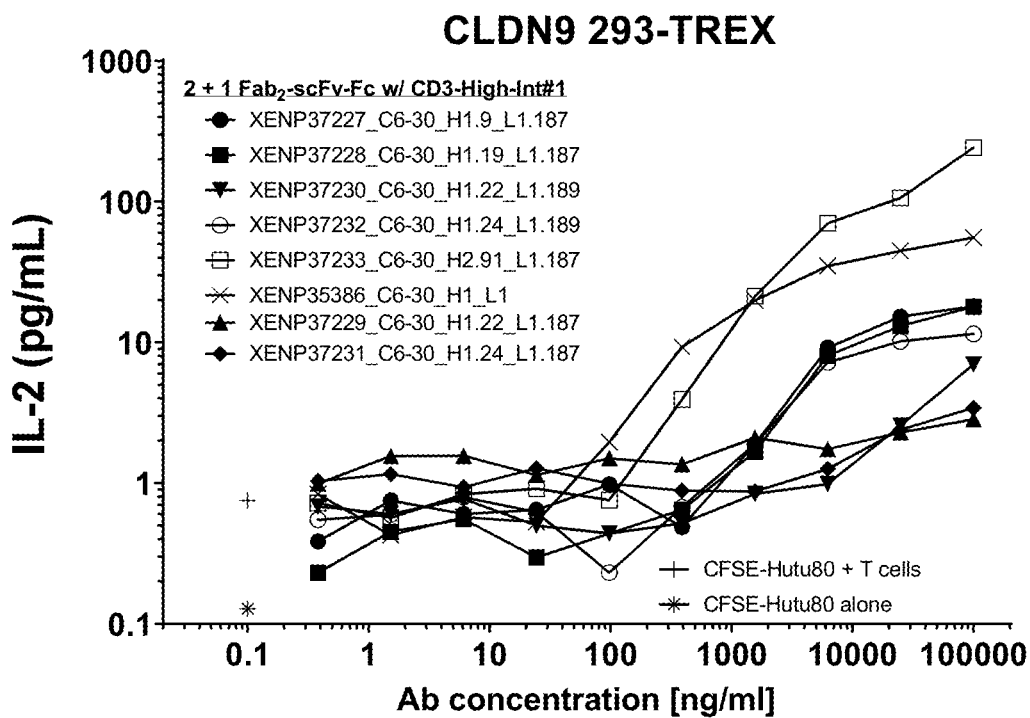

FIGS. 50A-50B depicts IL-2 secretion by T cells in the presence of A) HUTU-80 (CLDN6$^{high}$) and B) CLDN293-Trex stably transfected to express CLDN9 (CLDN9$^{high}$) by C6-30 formatted as 1+1 Fab-scFv-Fc or 2+1 Fab$_2$-scFv-Fc bsAbs with CD3 High or CD3 High-Int #1 (as indicated by IL-2 secretion).

Figure 51A:
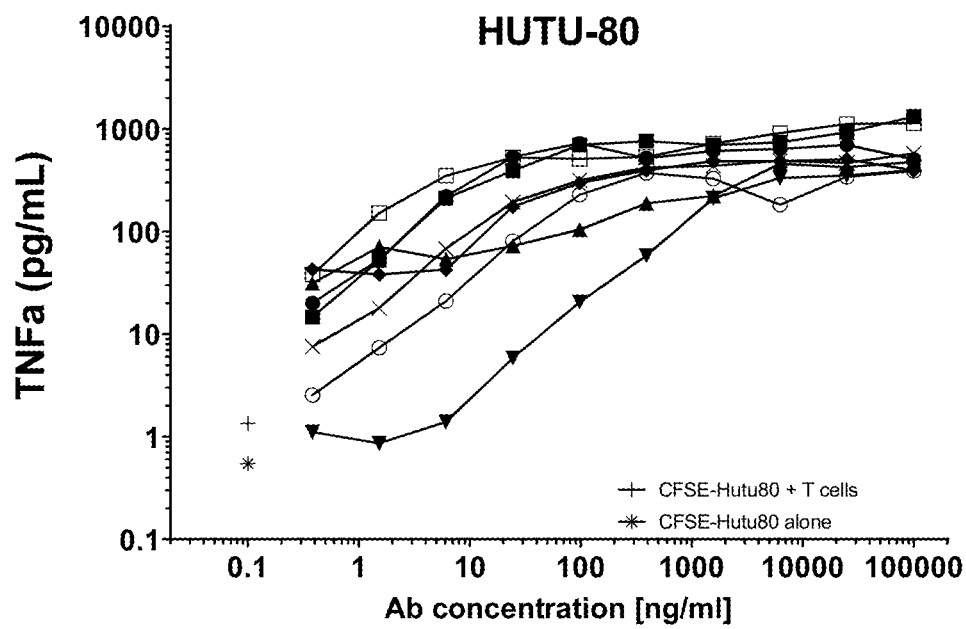
Figure 51B:
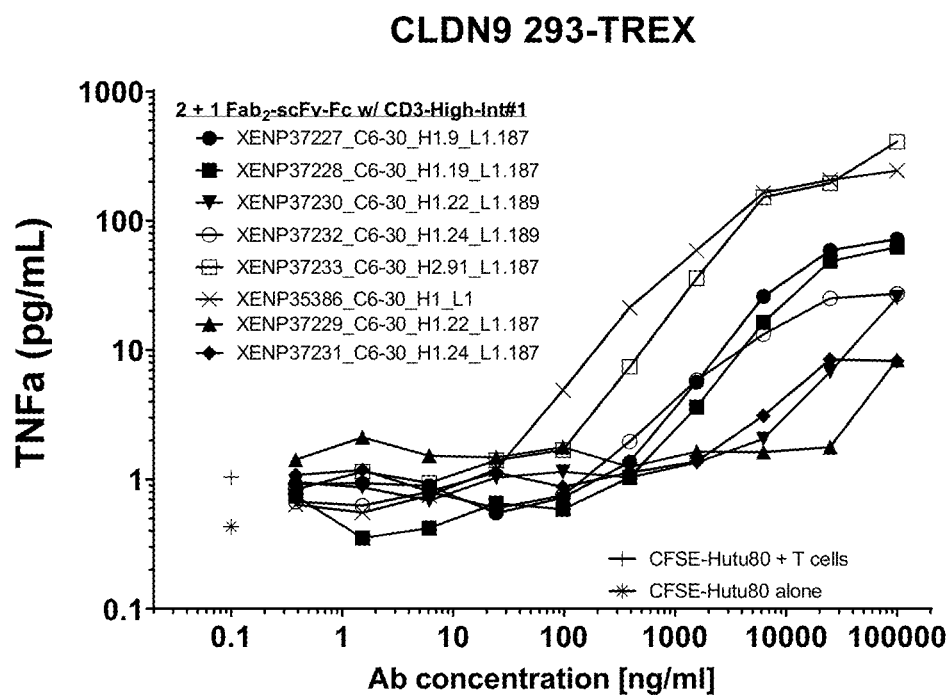
Figure 52A:
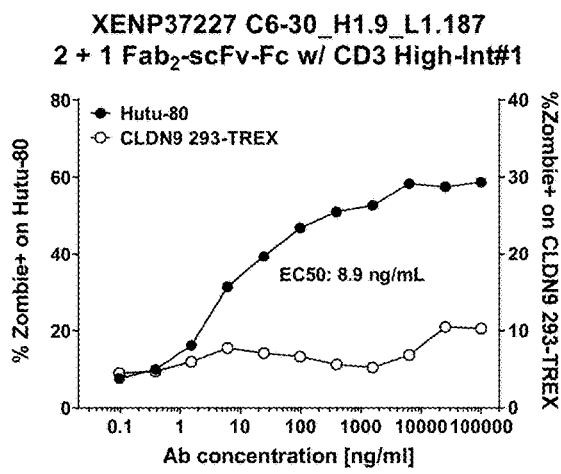
Figure 52B:
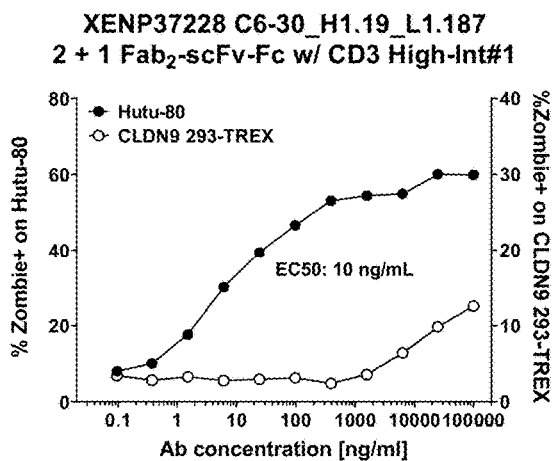
Figure 52C:
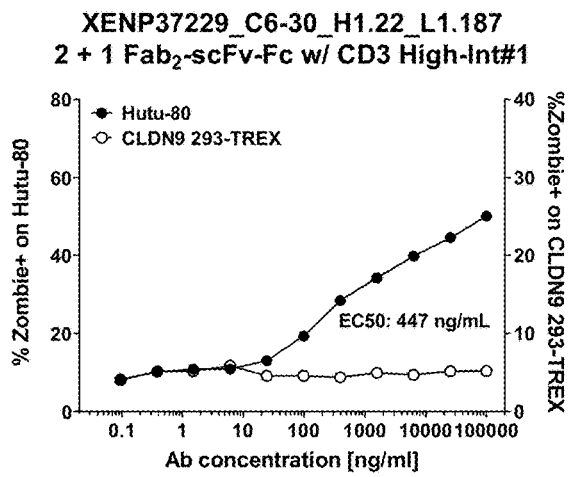
Figure 52D:
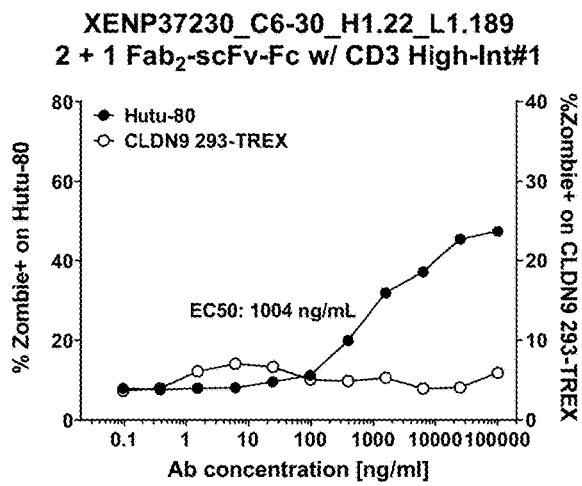
Figure 52E:
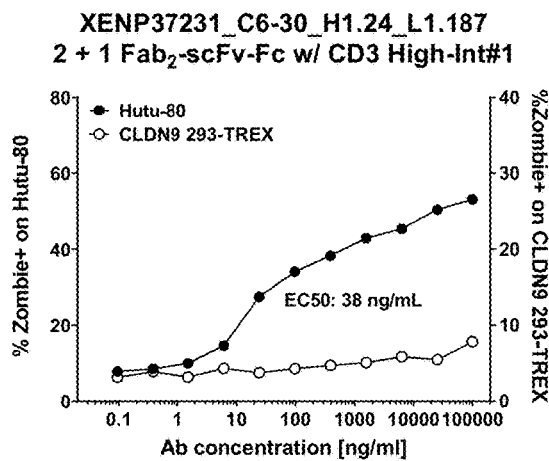
Figure 52F:
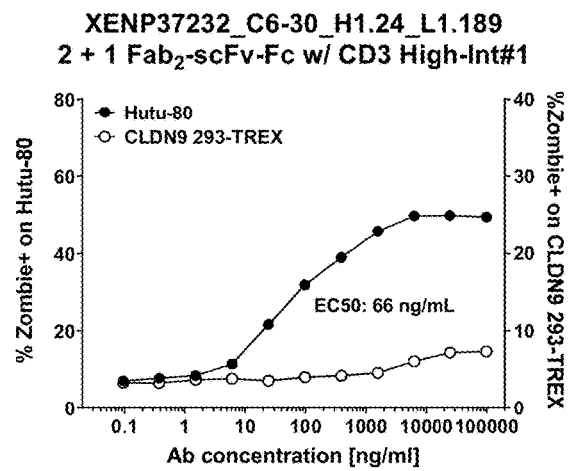
Figure 52G:
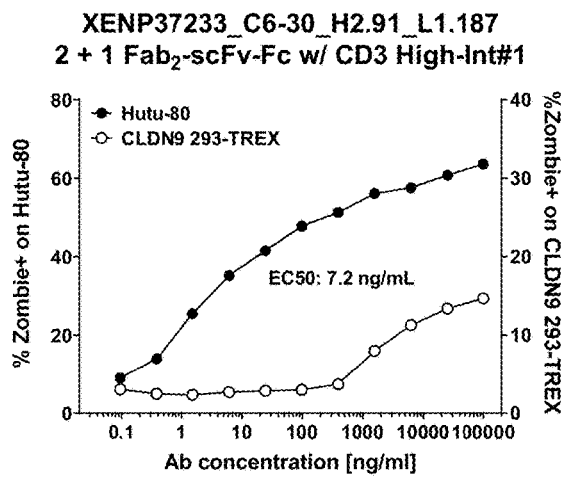
Figure 52H:
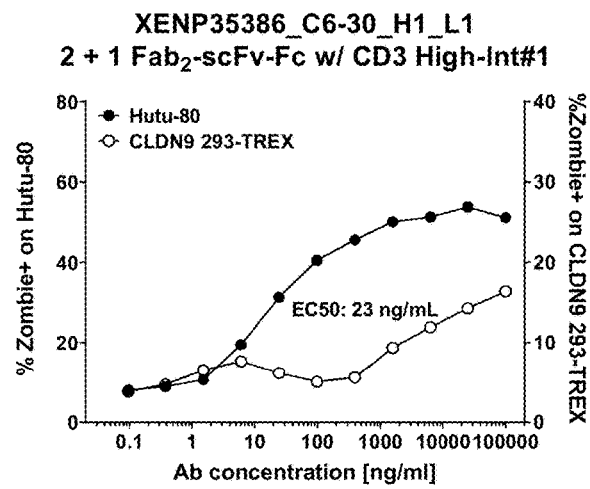

FIGS. 51A-51B depicts TNFα secretion by T cells in the presence of A) HUTU-80 (CLDN6$^{high}$) and B) CLDN293-Trex stably transfected to express CLDN9 (CLDN9$^{high}$) by C6-30 formatted as 1+1 Fab-scFv-Fc or 2+1 Fab$_2$-scFv-Fc bsAbs with CD3 High or CD3 High-Int #1 (as indicated by TNFα secretion).

FIGS. 52A-52H depict overlay of induction of RTCC on HUTU-80 (CLDN6$^{high}$) and CLDN293-Trex stably transfected to express CLDN9 (CLDN9$^{high}$) by A) XENP37227 (C6-30_H1.9_L1.187), B) XENP37228 (C6-30_H1.19_L1.187), C) XENP37229 (C6-30_H1.22_L1.187), D) XENP37230 (C6-30_H1.22_L1.189), E) XENP37231 (C6-30_H1.24_L1.187), F) XENP37232 (C6-30_H1.24_L1.189), G) XENP37233 (C6-30_H2.91_L1.187), and H) XENP35386 (C6-30_H1L1) each of which are bispecific antibodies in the 2+1 Fab$_2$-scFv-Fc format with CD3 High-Int #1. Each bsAb can be dosed at high concentrations to achieve efficacious killing of CLDN6$^+$ cells while avoiding killing of CLDN9$^+$ cells.

Figure 53A:
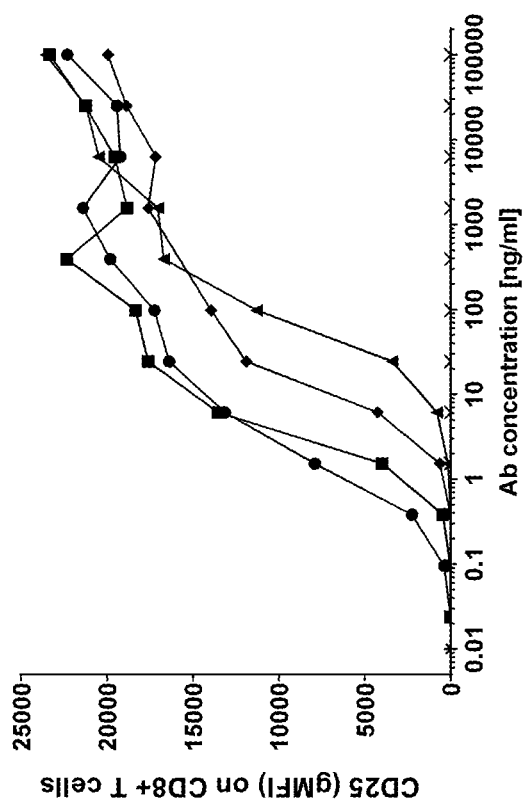
Figure 53B:
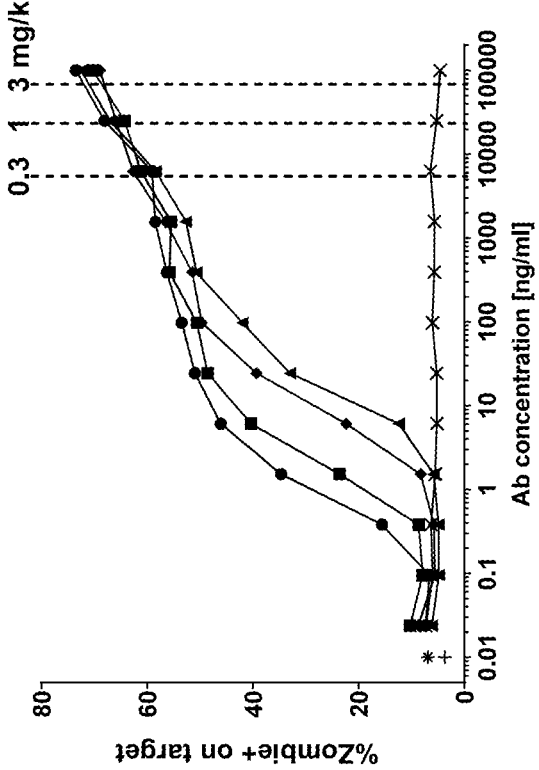

FIGS. 53A-53C depicts A) induction of RTCC (including EC50 values) on PA-1 (CLDN6$^{high}$) cells by XENP37233, XENP37227, XENP37231, and XENP37630 at a 1:1 effector:target ratio, as well a CD8$^+$ T cell activation as indicated by B) CD25 expression and C) CD107a expression.

Figure 54:
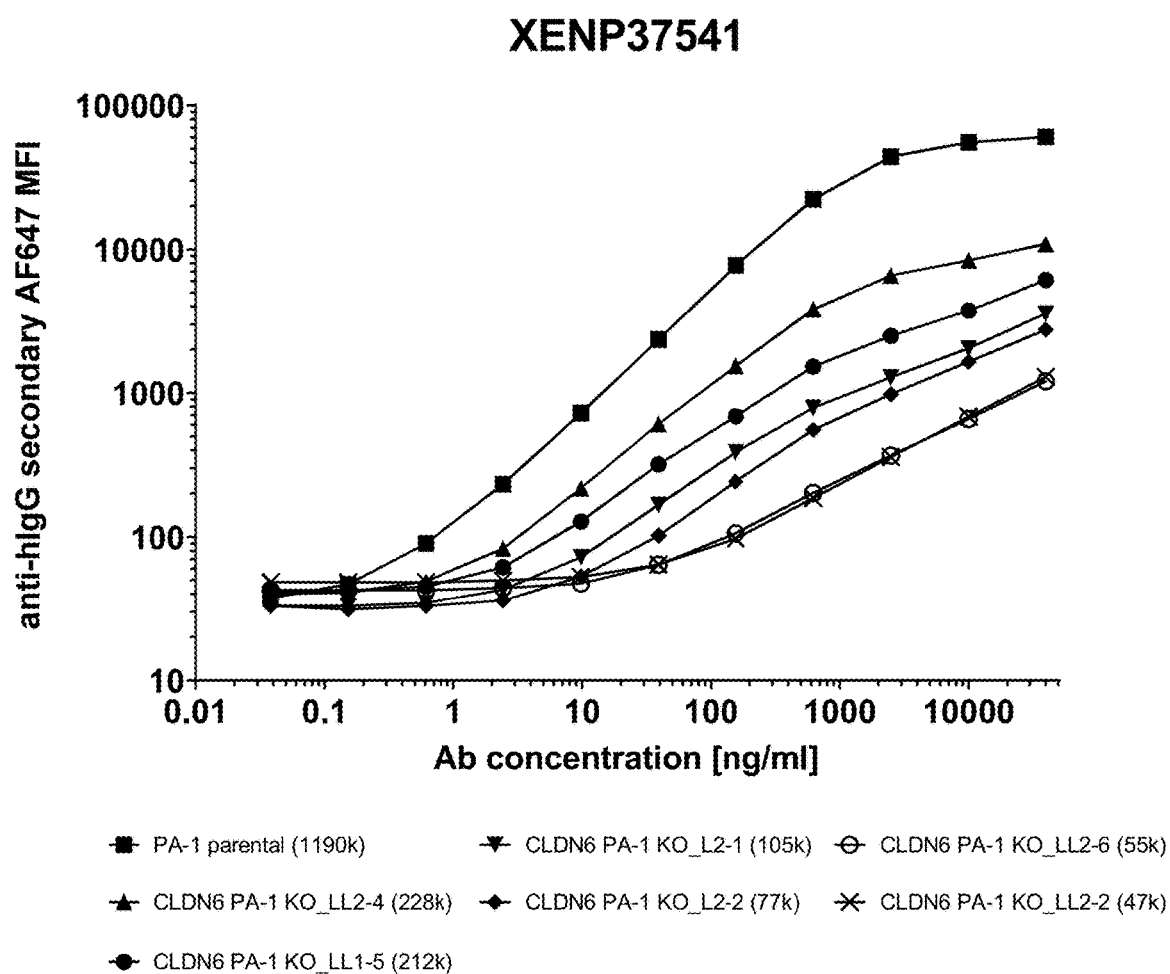

FIG. 54 depicts the ability of XENP37541 to bind cells expressing CLDN6 in a density dependent manner. PA-1 cells were engineered to stably express a range of CLDN6 antigen densities. XENP37541 was incubated with cells at a range of doses. Cells were washed, stained with a secondary antibody, and washed again prior to being analyzed using flow cytometry. XENP37541 was able to bind cells with lower levels of CLDN6 expression, even down to 47 k CLDN6 antigens per cell.

Figure 55:
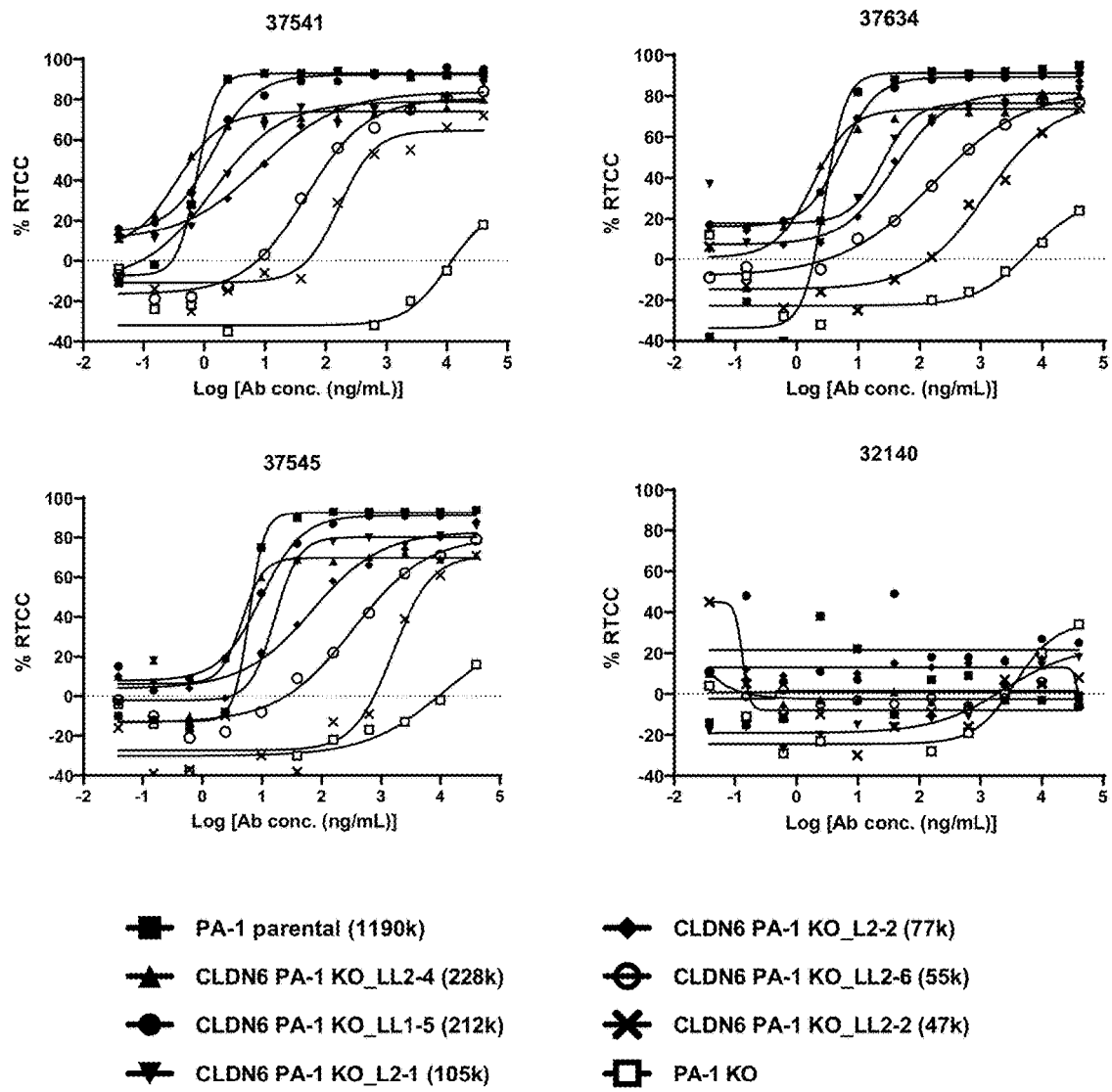

FIG. 55 depicts the induction of RTCC on PA-1 cells engineered to express a range of CLDN6 antigen levels, which are annotated in the EC50 chart in the figure. A 1:1 effector:target cell ratio and 72 hour incubation time was used before measuring RTCC. The results show that XENP37541, XENP37634, and XENP37545 were all able to induce RTCC in a CLDN6 density dependent manner, while negative control RSVxCD3 bsAb XENP32140 was not. XENP37541 displayed the strongest potency and lowest EC50 values across all different levels of CLDN6 expression.

Figure 56B:
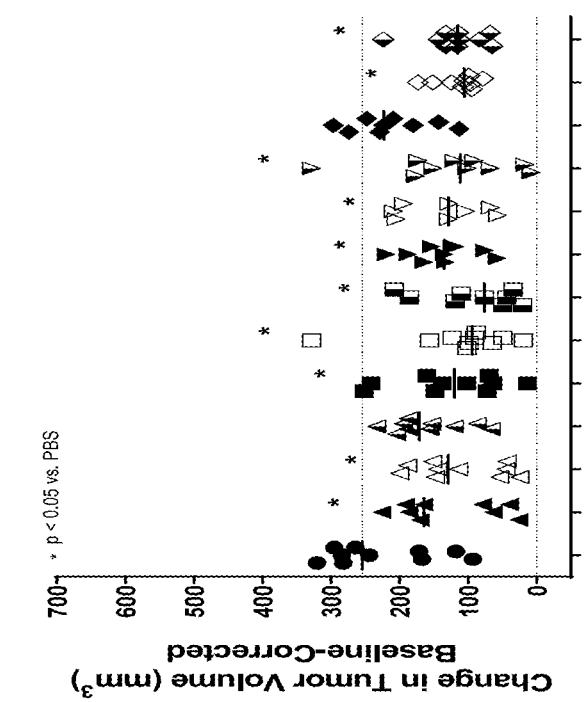
Figure 56A:
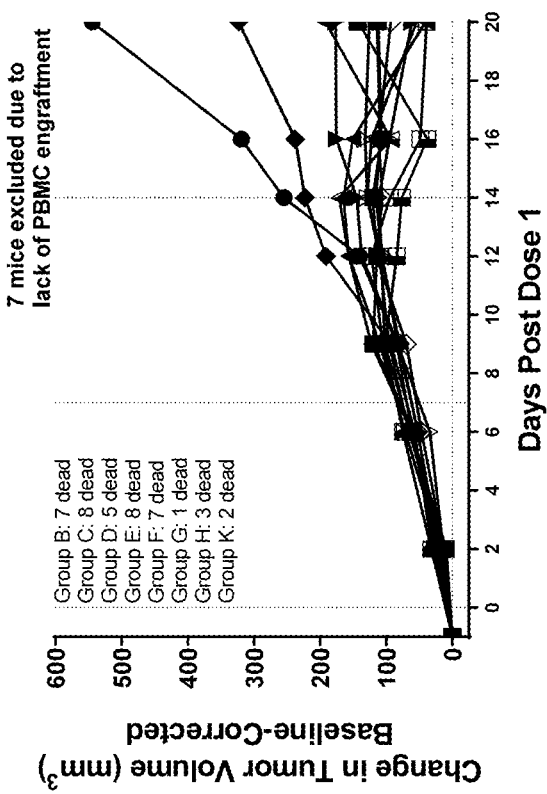
Figure 56C:
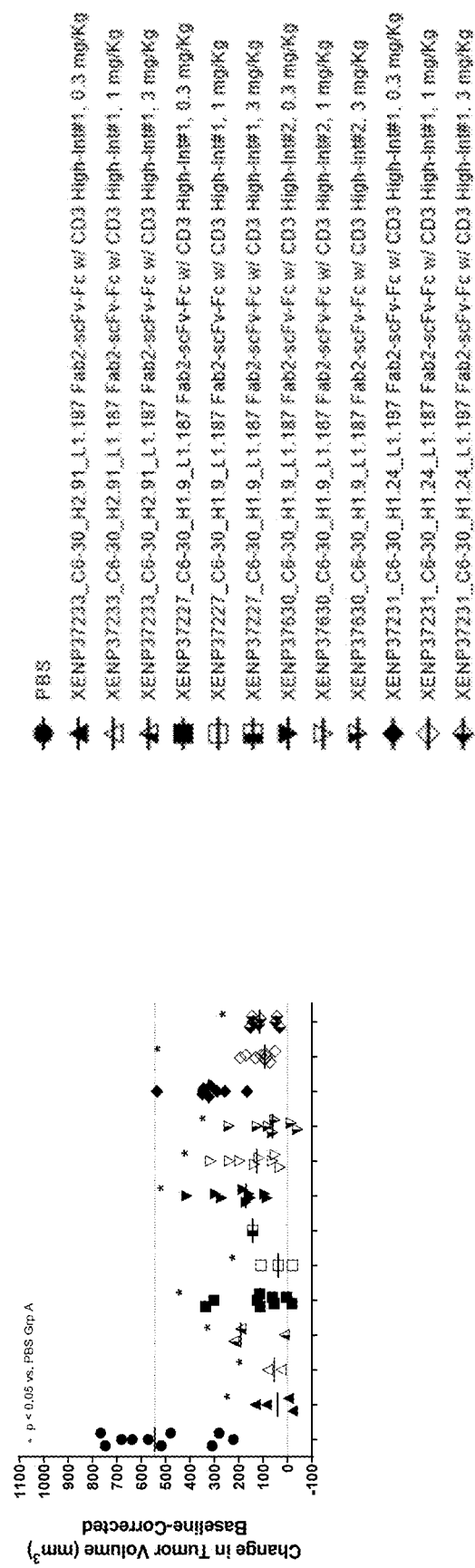
Figure 57B:
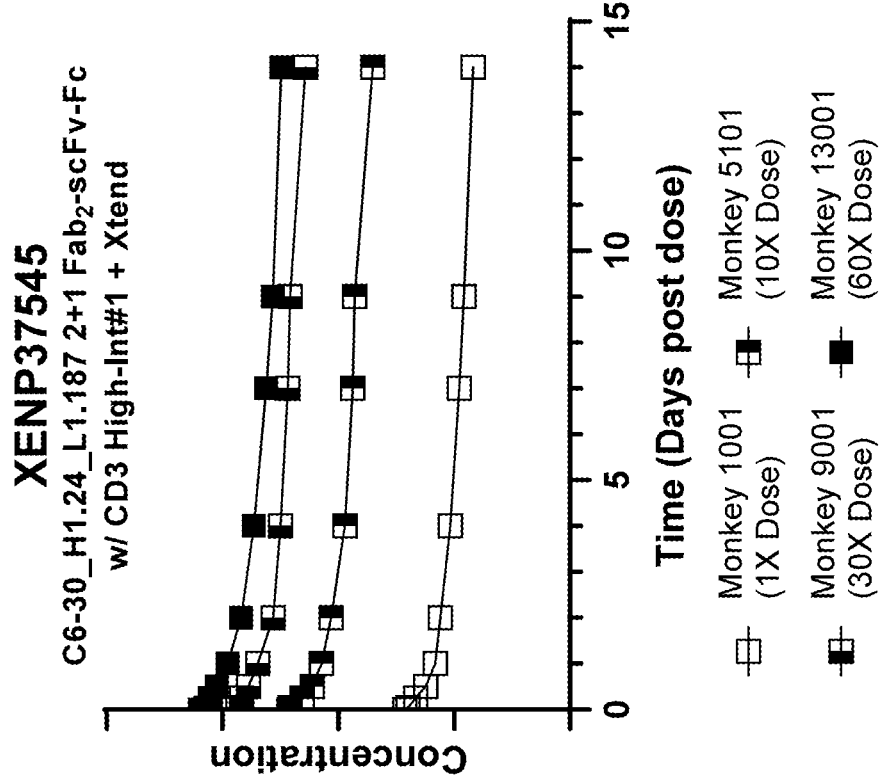
Figure 57A:
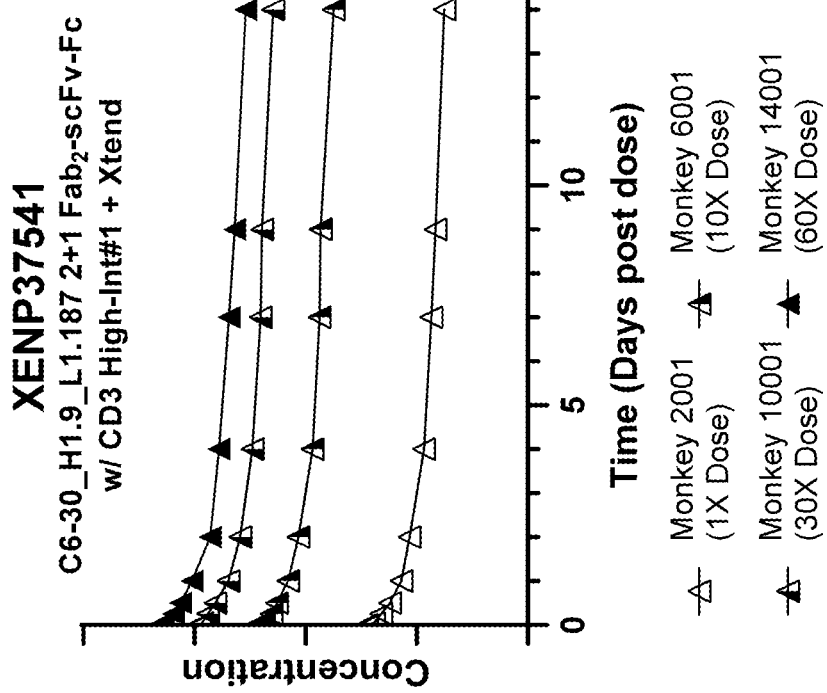
Figure 57D:
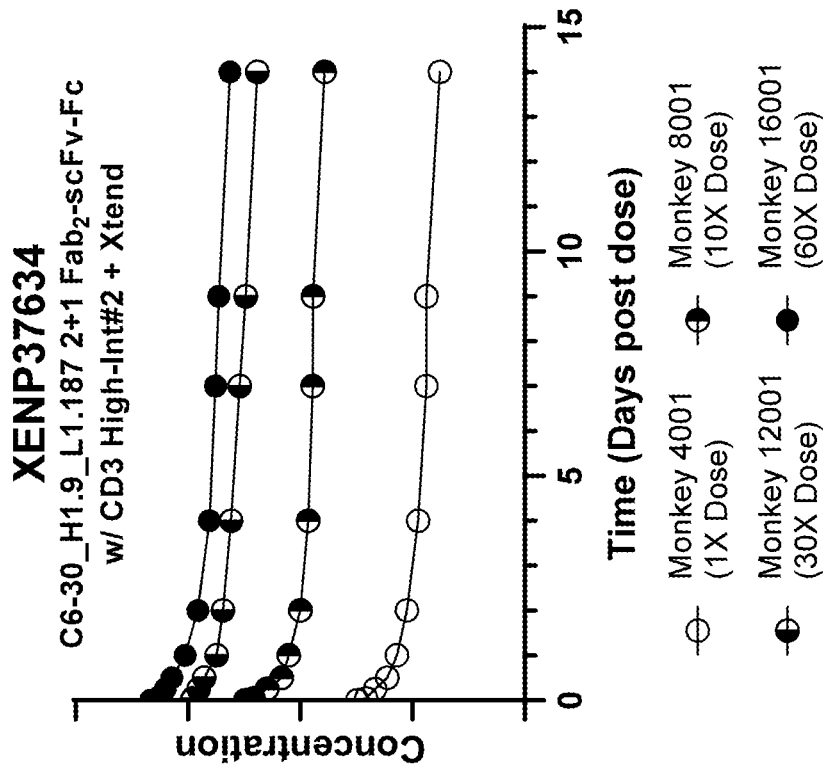
Figure 57C:
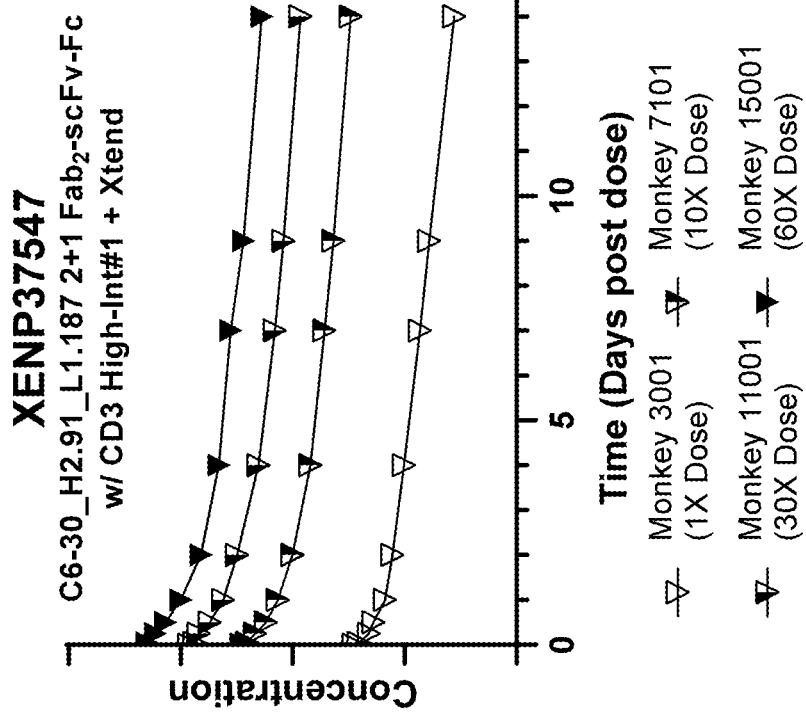

FIGS. 56A-56C depict the change in tumor volume (as determined by caliper measurements) A) over time, B) by Day 14 and C) by Day 20 (after 1$^{st}$ dose on Day 0) in PA-1 and huPBMC-engrafted NSG mice dosed with PBS and XENP37233, XENP37227, XENP37630, or XENP37231 at 0.3, 1.0, or 3.0 mg/kg* indicates p<0.05 vs. PBS group (statistical analysis performed using Mann-Whitney test on baseline corrected tumor volume). By Day 14, each of the bispecific antibodies enhanced anti-tumor activity in comparison to PBS control.

FIGS. 57A-57D depicts dose response observed in pharmacokinetics for each of A) XENP37541, B) XENP37545, C) XENP37547, and D) XENP37634.

Figure 58:
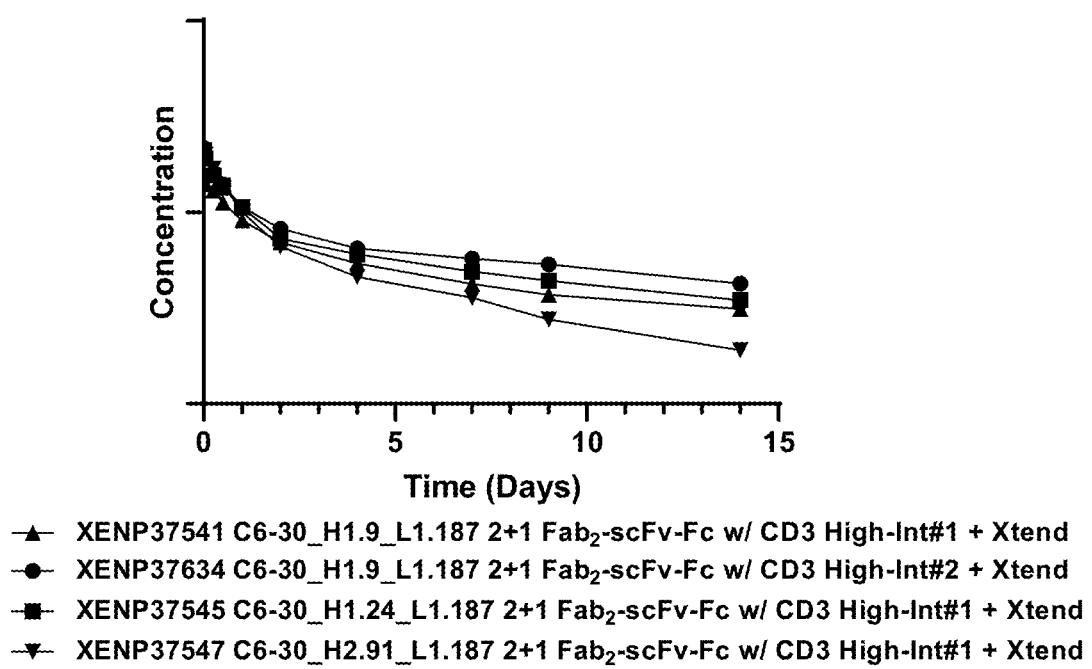

FIG. 58 depicts overlay of blood concentration of for each of XENP37541, XENP37545, XENP37547, and XENP37634 following 60x dose.

FIGS. 59A and 59B depict the sequences for illustrative αCLDN6xαCD3 bsAbs in the 2+1 Fab$_2$-scFv-Fc format and comprising a CD3 High-Int #2 scFv (H1.89_L1.47 in either the VHVL orientation or the VLVH orientation). CDRs are underlined and slashes indicate the border(s) between the variable regions and other chain components (e.g. constant region and domain linkers). It should be noted that the αCLDN6xαCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIGS. 60A and 60B depict sequences comprising a comparator CLDN6 binding domain Comp CH002. XENP37217 comprises this comparator CLDN6 binding domain in the 2+1 Fab$_2$-scFv-Fc format, while XENP38084 comprises the binding domain in the bivalent antibody format.

Figure 61A:
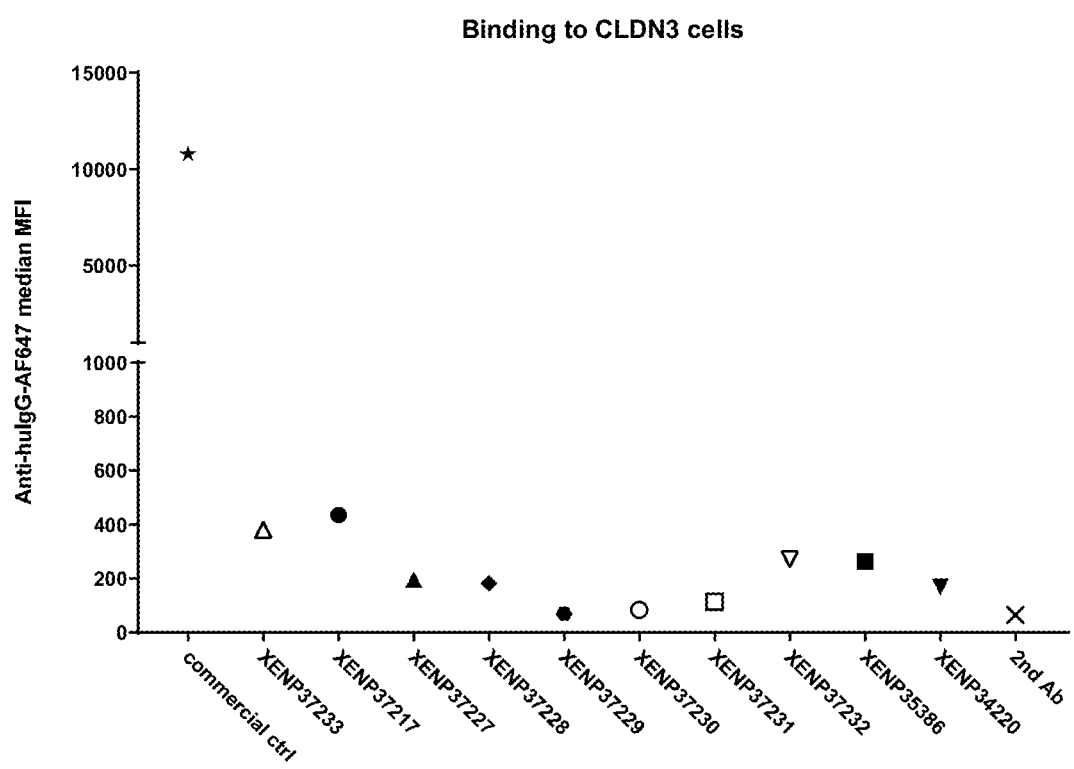
Figure 61B:
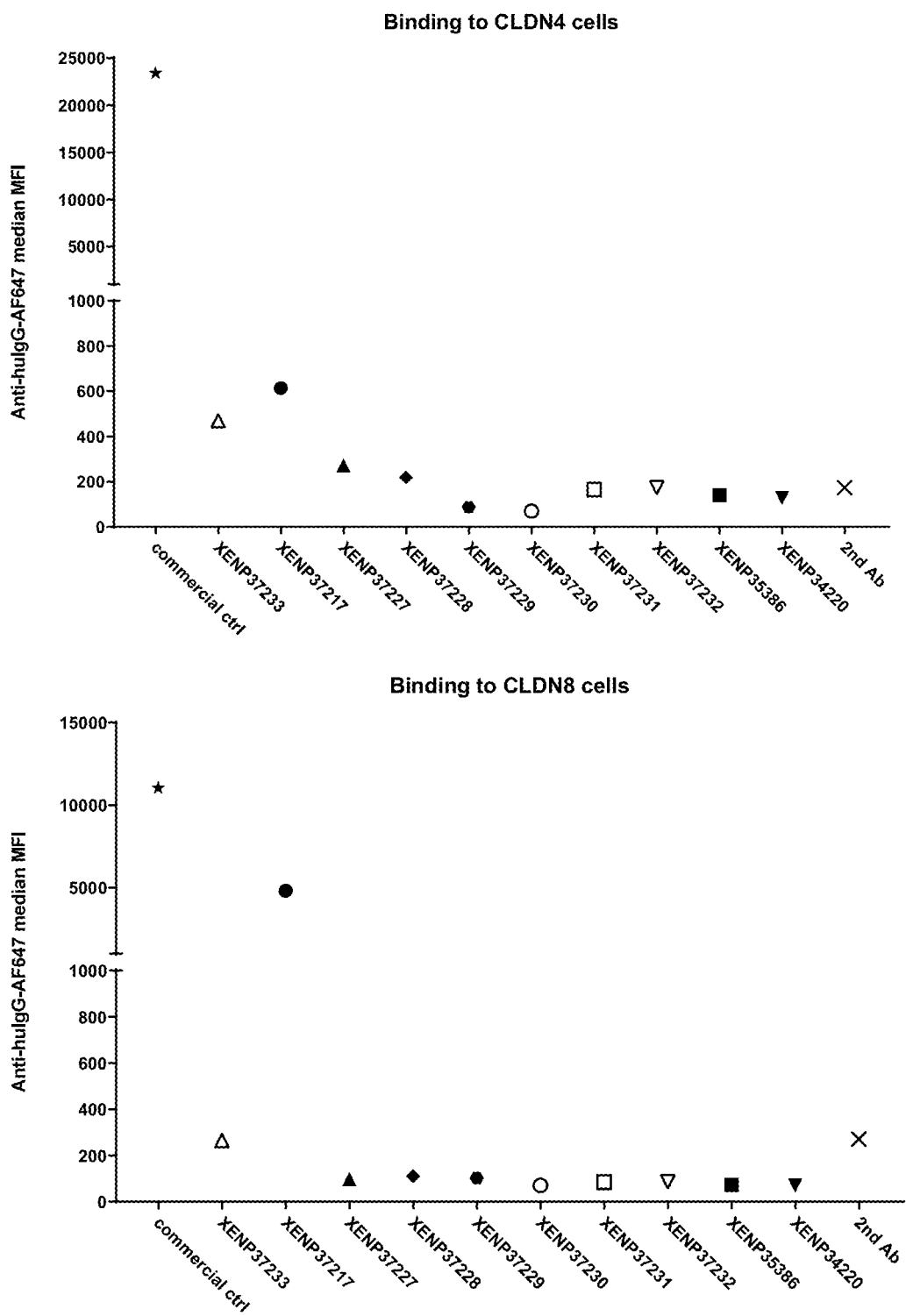
Figure 61C:
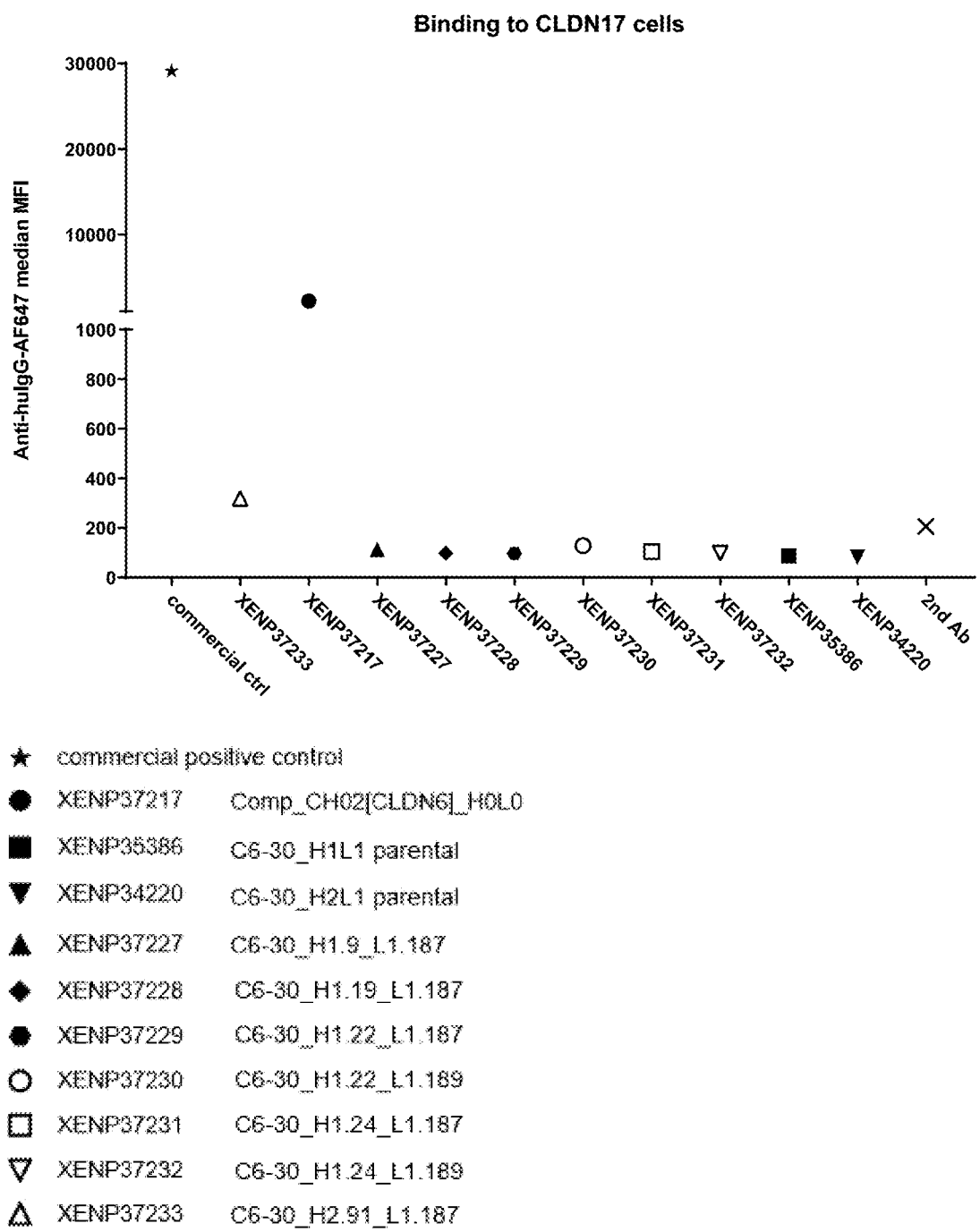

FIGS. 61A-61C depict the binding of C6-30 variants, as well as comparator CLDN6xCD3 bsAb XENP37217, to other claudin family members CLDN3, CLDN4, CLDN8 and CLDN17. 293 cells were transiently transfected to express CLDN3, CLDN4, CLDN8, or CLDN17. Cells were plated and each test article was added to each cell line at a 100 μg/ml dose. After 1 hour incubation at 4° C., cells were washed and a secondary AF647 antibody was added. Cells were incubated at 4° C. for another hour, followed by additional washing and then analysis by flow cytometry. Comparator molecule XENP37217 showed significantly higher binding to CLDN8 and CLDN17 than any of the C6-30 variants.

DETAILED DESCRIPTION

The present invention provides heterodimeric bispecific antibodies that bind to human CD3ε and human CLDN6.

I. Overview

Anti-bispecific antibodies that co-engage CD3 and a tumor antigen target are used to redirect T cells to attack and lyse targeted tumor cells. Examples include the BiTE® and DART formats, which monovalently engage CD3 and a tumor antigen. While the CD3-targeting approach has shown considerable promise, a common side effect of such therapies is the associated production of cytokines, often leading to toxic cytokine release syndrome. Because the anti-CD3 binding domain of the bispecific antibody engages all T cells, the high cytokine-producing CD4 T cell subset is recruited. Moreover, the CD4 T cell subset includes regulatory T cells, whose recruitment and expansion can potentially lead to immune suppression and have a negative impact on long-term tumor suppression. In addition, these formats do not contain Fc domains and show very short serum half-lives in patients.

Provided herein are novel anti-CD3xanti-CLDN6 (also referred to as anti-CLDN6xanti-CD3, αCD3xαCLDN6, αCLDN6xαCD3 or sometimes just CLDN6xCD3) heterodimeric bispecific antibodies and methods of using such antibodies for the treatment of cancers. In particular, provided herein are anti-CD3, anti-CLDN6 bispecific antibodies in a variety of formats. These bispecific antibodies are useful for the treatment of cancers, particularly those with increased CLDN6 expression such as renal cell carcinoma. Such antibodies are used to direct CD3+ effector T cells to CLDN6+ tumors, thereby allowing the CD3+ effector T cells to attack and lyse the CLDN6+ tumors.

Additionally, the bispecific antibodies of the invention additionally distinguish between CLDN6 and other members of the CLDN family. While CLDN6 is expressed on cancers, CLDN9 is more highly expressed in healthy tissues (e.g. the cervix and the esophagus), so cross-reactivity of CLDN6 therapeutic with CLDN9 could lead to off-target toxicity. However, CLDN6 is 96% identical to CLDN9, differing by only 3 residues in their extracellular loops (as depicted in FIG. 12); therefore, it is a significant challenge to develop an antibody capable of binding CLDN6 selectively over CLDN9, as well as selectivity of CLDN6 antigen binding domains (ABDs) that bind CLDN6 preferentially over other members of the CLDN family, including CLDN3 and CLDN4. Thus, included in the present invention are antibodies and/or antigen binding domains that bind CLDN6 preferentially over CLDN9 as well as these ABDs in anti-CLDN6×anti-CD3 bispecific antibodies.

Additionally, in some embodiments, the disclosure provides bispecific antibodies that have different binding affinities to human CD3 that can alter or reduce the potential side effects of anti-CD3 therapy. That is, in some embodiments the antibodies described herein provide antibody constructs comprising anti-CD3 antigen binding domains that are "strong" or "high affinity" binders to CD3 (e.g. one example are heavy and light variable domains depicted as H1.30_L1.47 (optionally including a charged linker as appropriate)) and also bind to CLDN6. In other embodiments, the antibodies described herein provide antibody constructs comprising anti-CD3 antigen binding domains that are "lite" or "lower affinity" binders to CD3. Additional embodiments provides antibody constructs comprising anti-CD3 antigen binding domains that have intermediate or "medium" affinity to CD3 that also bind to CLDN6. While a very large number of anti-CD3 antigen binding domains (ABDs) can be used, particularly useful embodiments use 6 different anti-CD3 ABDs, although they can be used in two scFv orientations as discussed herein. Affinity is generally measured using a Biacore assay.

Figure 17A:
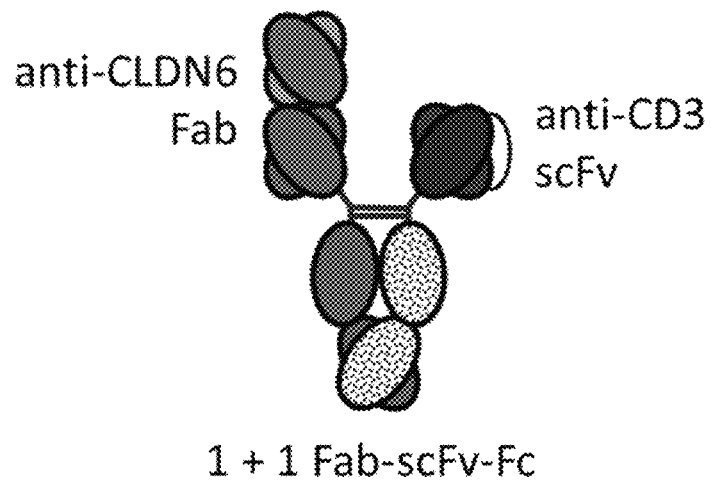
FIGS. 17A and 17B depict a couple of formats of the present invention.
Figure 17B:
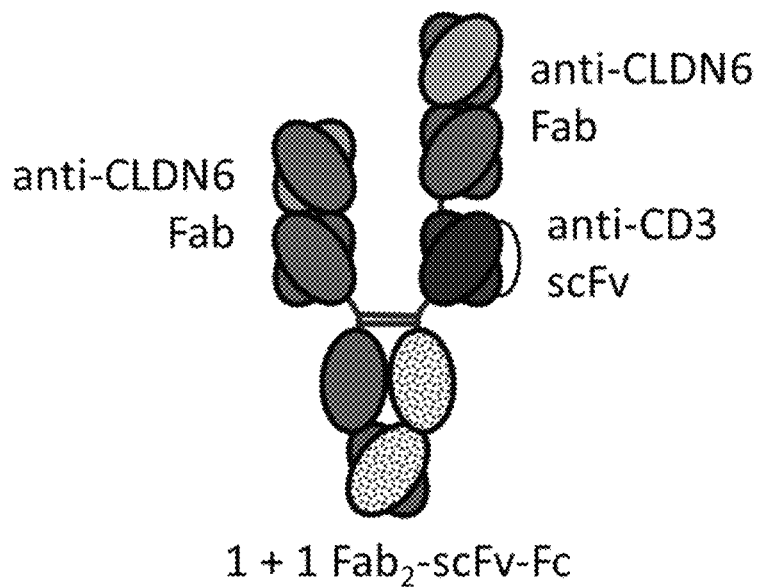
Figure 23A:
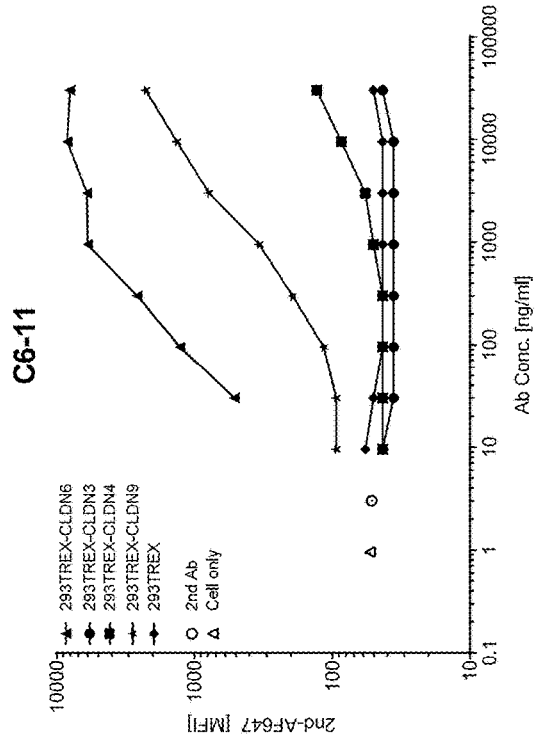
Figure 23B:
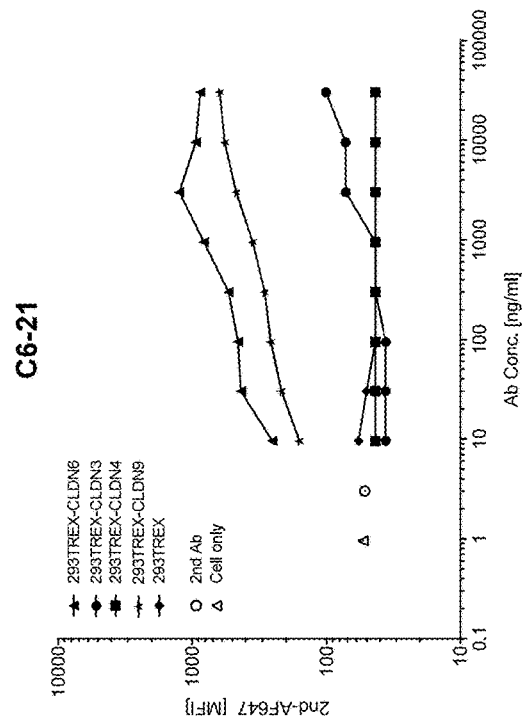
Figure 23C:
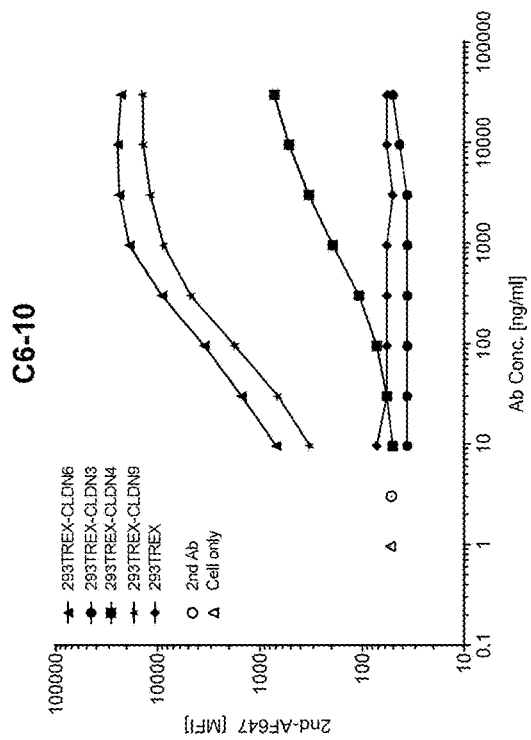
Figure 23D:
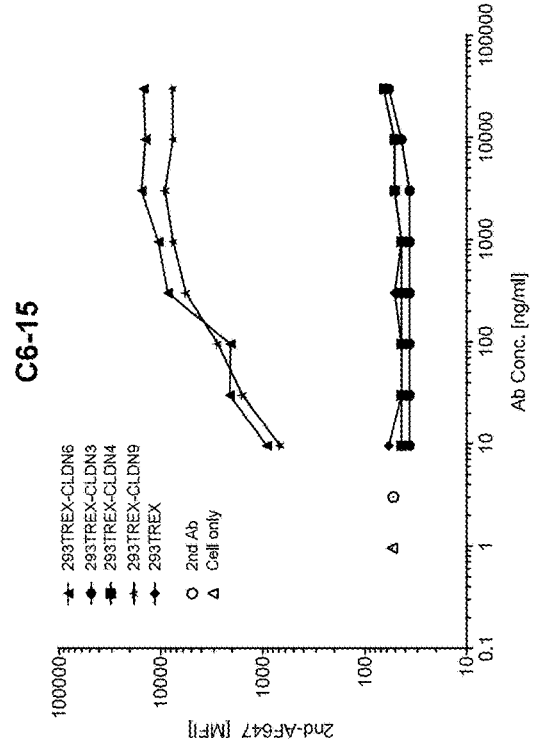
Figure 24A:
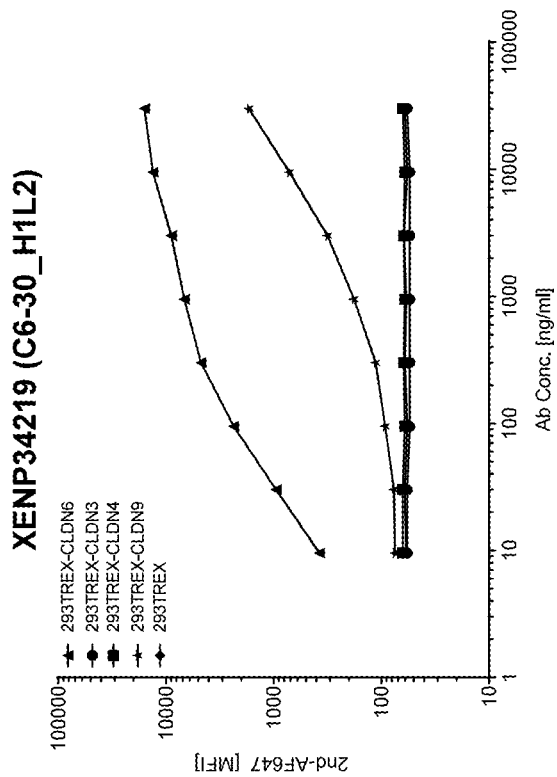
FIGS. 24A-24E depicts binding of humanized variants of C6-30 in different humanization frameworks—(A) H1L1, (B) H1L2, (C) H2L1, (D) H2L2, and (E) the original mouse mAb to HEK293-Trex cells that have been transfected to stably express human CLDN6, CLDN3, CLDN4, or CLDN9 as well as parental HEK293-Trex cells. Clones C6-11, C6-24, and C6-30 showed selectivity for CLDN6 over CLDN9. Each of the humanized variants of C6-30 retained selectivity for CLDN6 over CLDN9 (as well as over CLDN3 and CLDN4).
Figure 24B:
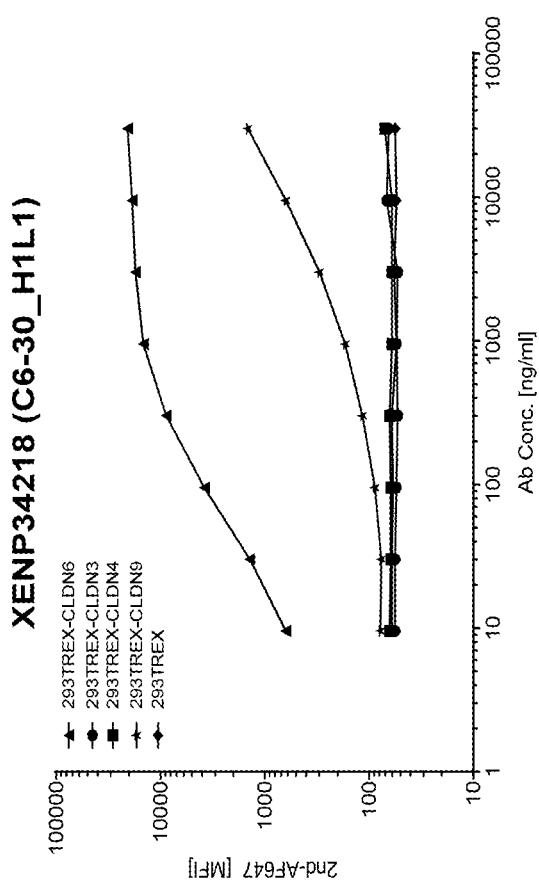
Figure 24C:
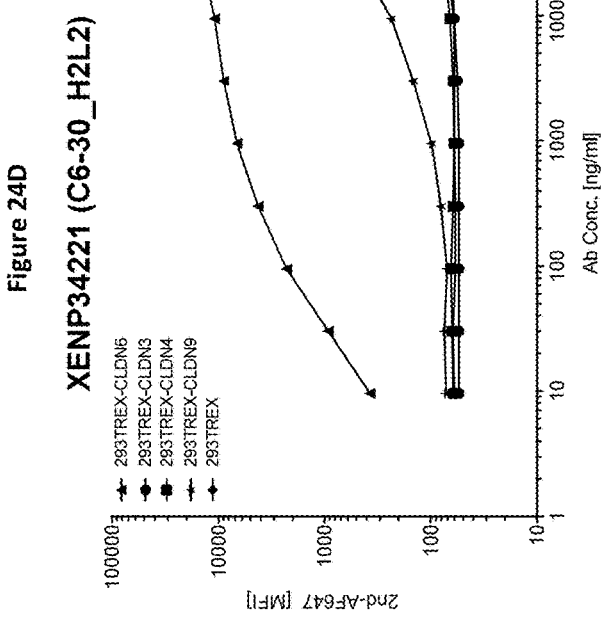
Figure 24D:
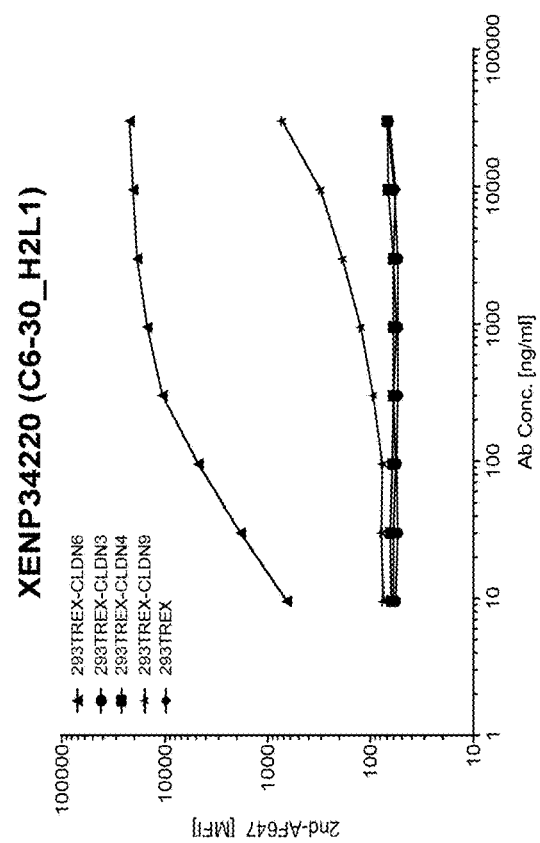
Figure 24E:
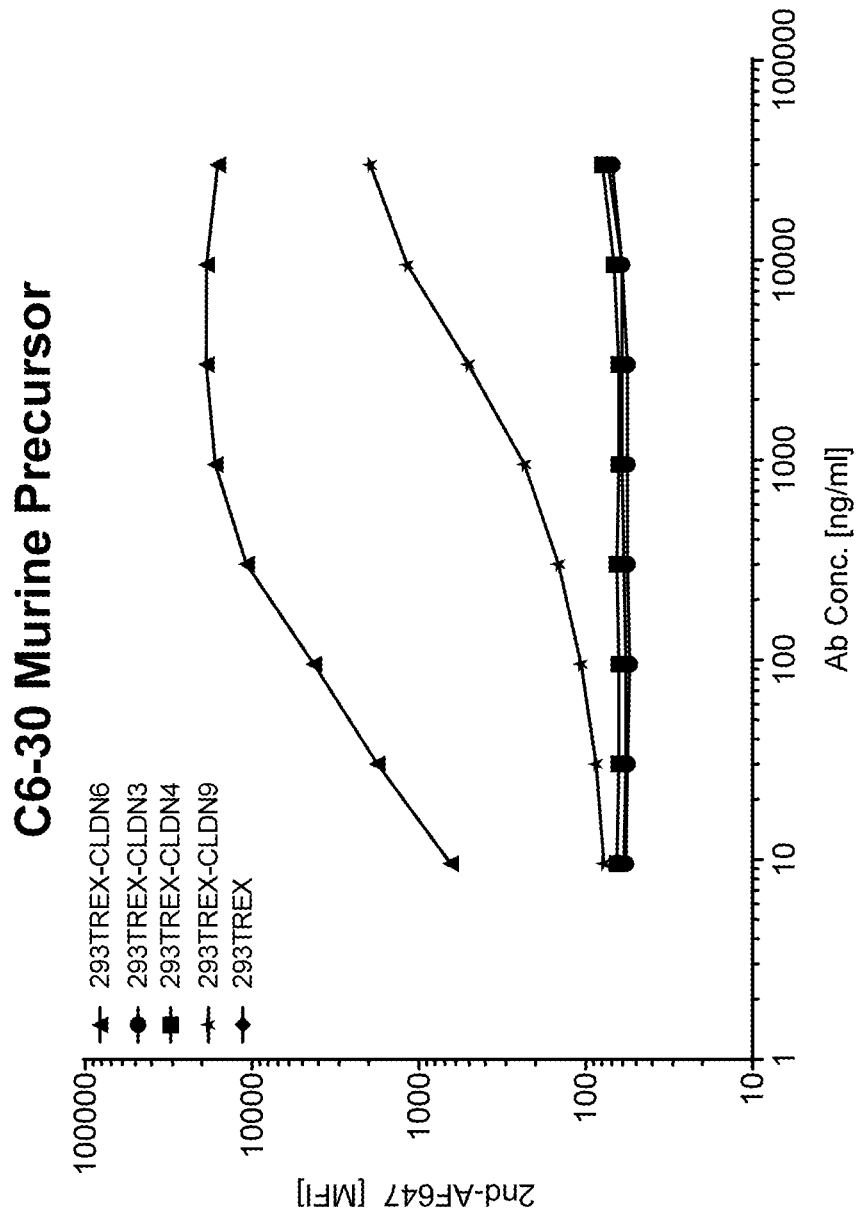
Figure 25A:
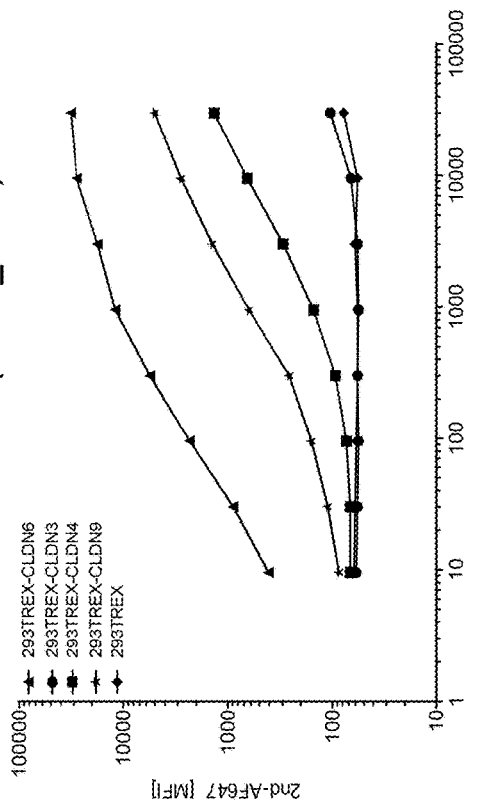
FIGS. 25A-25E depicts binding of humanized variants of C6-11 in different humanization frameworks—(A) H1L1, (B) H1L2, (C) H2L1, (D) H2L2, and (E) the original mouse mAb to HEK293-Trex cells that have been transfected to stably express human CLDN6, CLDN3, CLDN4, or CLDN9 as well as parental HEK293-Trex cells. Clones C6-11, C6-24, and C6-30 showed selectivity for CLDN6 over CLDN9. Each of the humanized variants of C6-30 retained selectivity for CLDN6 over CLDN9 (as well as over CLDN3 and CLDN4).
Figure 25B:
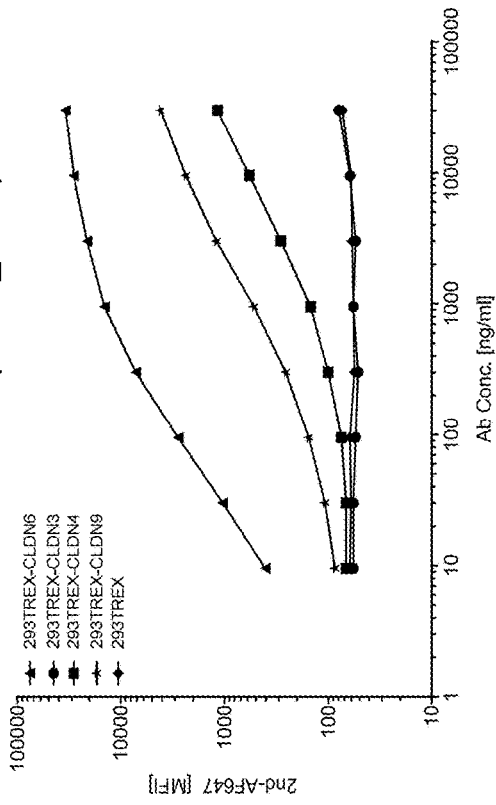
Figure 25C:
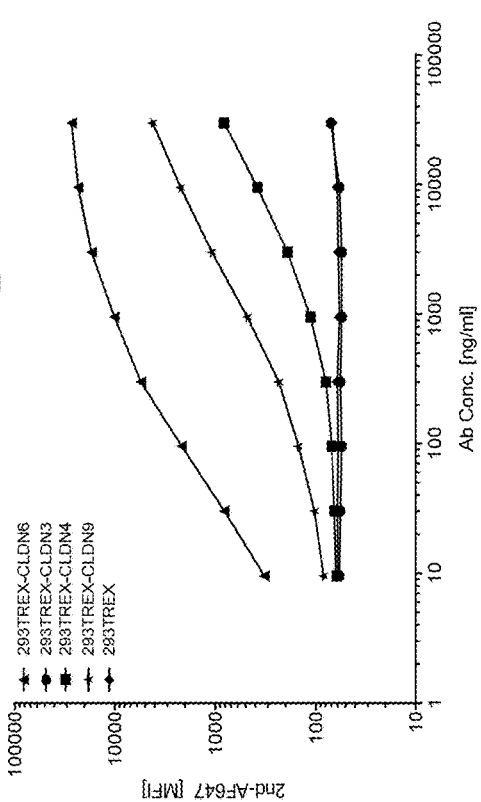
Figure 25D:
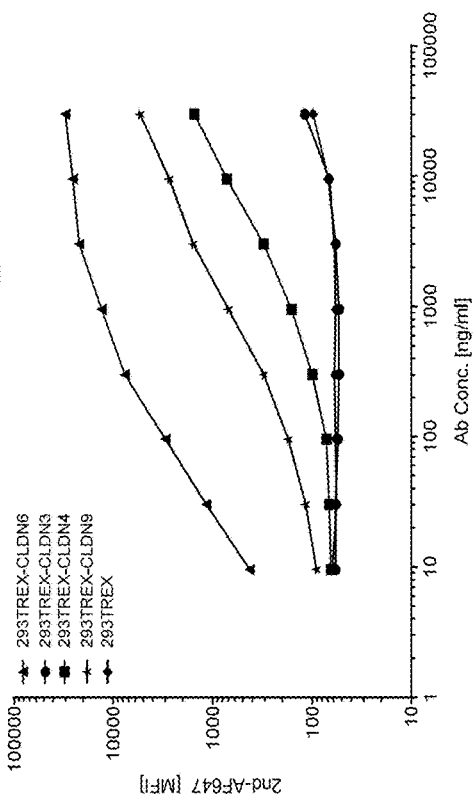
Figure 25E:
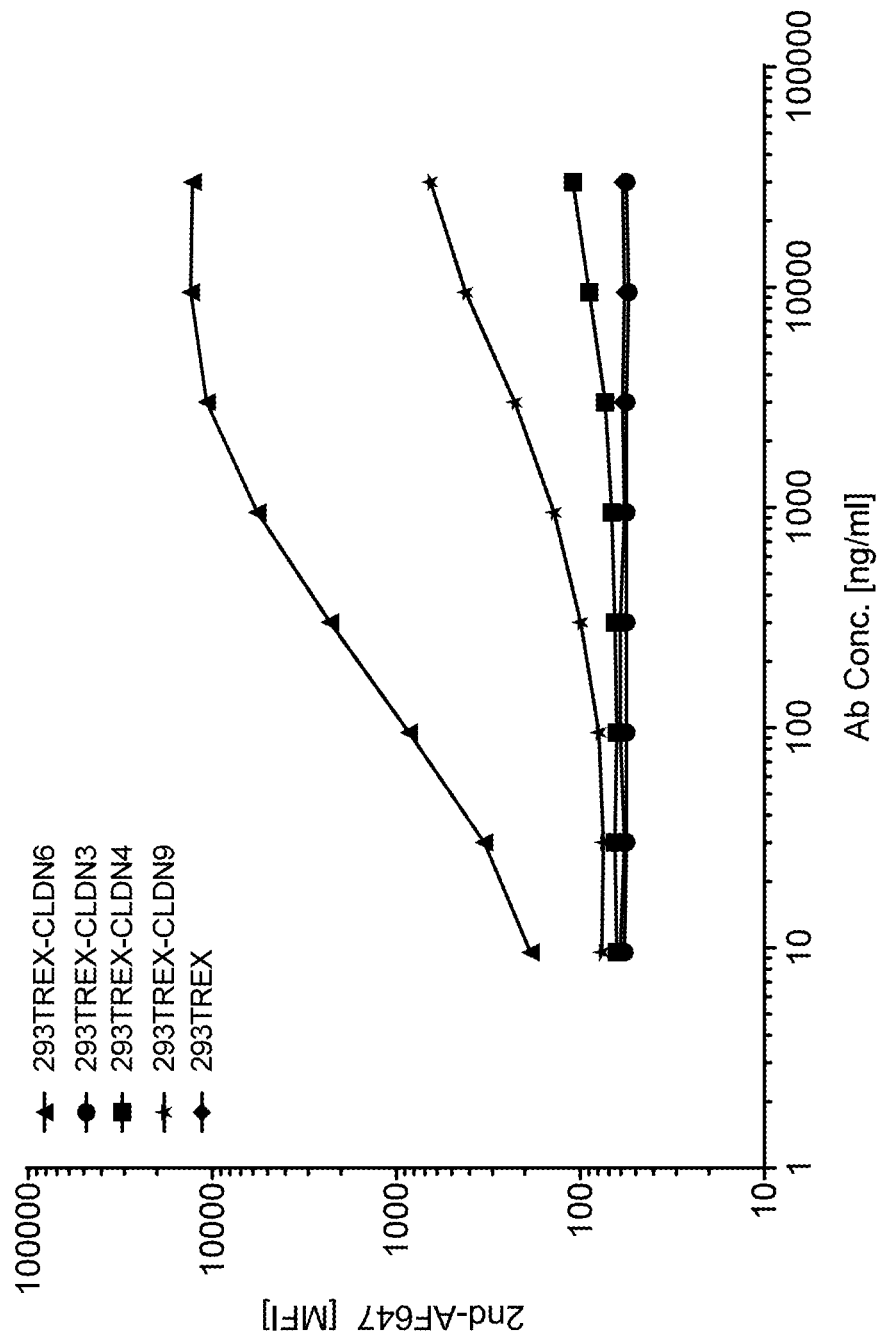

It should be appreciated that the "high, medium, low" anti-CD3 sequences provided herein can be used in a variety of heterodimerization formats as discussed herein. In general, due to the potential side effects of T cell recruitment, exemplary embodiments utilize formats that only bind CD3 monovalently, such as depicted in FIGS. 17A and 17B, and in the formats depicted herein, it is the CD3 ABD that is a scFv as more fully described herein. In contrast, the subject bispecific antibodies can bind CLDN6 either monovalently (e.g. FIG. 17A) or bivalently (e.g. FIG. 17B).

Provided herein are compositions that include CLDN6 binding domains, including antibodies with such CLDN6 binding domains (e.g., CLDN6×CD3 bispecific antibodies). Subject antibodies that include such CLDN6 binding domains advantageously elicit a range of different immune responses, depending on the particular CLDN6 binding domain used. For example, the subject antibodies exhibit differences in selectivity for cells with different CLDN6 expression, potencies for CLDN6 expressing cells, ability to elicit cytokine release, and sensitivity to soluble CLDN6. Such CLDN6 binding domains and related antibodies find use, for example, in the treatment of CLDN6-associated cancers.

Accordingly, in one aspect, provided herein are heterodimeric antibodies that bind to two different antigens, e.g. the antibodies are "bispecific", in that they bind two different target antigens, generally CLDN6 and CD3 as described herein. These heterodimeric antibodies can bind these target antigens either monovalently (e.g. there is a single antigen binding domain such as a variable heavy and variable light domain pair) or bivalently (there are two antigen binding domains that each independently bind the antigen). In some embodiments, the heterodimeric antibody provided herein includes one CD3 binding domain and one CLDN6 binding domain (e.g., heterodimeric antibodies in the "1+1 Fab-scFv-Fc" format described herein). In other embodiments, the heterodimeric antibody provided herein includes one CD3 binding domain and two CLDN6 binding domains (e.g., heterodimeric antibodies in the "2+1 Fab2-scFv-Fc" formats described herein). The heterodimeric antibodies provided herein are based on the use different monomers which contain amino acid substitutions that "skew" formation of heterodimers over homodimers, as is more fully outlined below, coupled with "pI variants" that allow simple purification of the heterodimers away from the homodimers, as is similarly outlined below. The heterodimeric bispecific antibodies provided generally rely on the use of engineered or variant Fc domains that can self-assemble in production cells to produce heterodimeric proteins, and methods to generate and purify such heterodimeric proteins.

II. Nomenclature

The antibodies provided herein are listed in several different formats. In some instances, each monomer of a particular antibody is given a unique "XENP" number, although as will be appreciated in the art, a longer sequence might contain a shorter one. For example, a "scFv-Fc" monomer of a 1+1 Fab-scFv-Fc format antibody may have a first XENP number, while the scFv domain itself will have a different XENP number. Some molecules have three polypeptides, so the XENP number, with the components, is used as a name. Thus, the molecule XENP37630, which is in 2+1 Fab$_2$-scFv-Fc format, comprises three sequences (see FIG. 59A) a "Fab-Fc Heavy Chain" monomer ("Chain 1"); 2) a "Fab-scFv-Fc Heavy Chain" monomer ("Chain 2"); and 3) a "Light Chain" monomer ("Chain 3") or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab includes, the full heavy chain sequence, the variable heavy domain sequence and the three CDRs of the variable heavy domain sequence, the full light chain sequence, a variable light domain sequence and the three CDRs of the variable light domain sequence. A Fab-scFv-Fc monomer includes a full length sequence, a variable heavy domain sequence, 3 heavy CDR sequences, and an scFv sequence (include scFv variable heavy domain sequence, scFv variable light domain sequence and scFv linker). Note that some molecules herein with a scFv domain use a single charged scFv linker (+H), although others can be used. In addition, the naming nomenclature of particular antigen binding domains (e.g., CLDN6 and CD3 binding domains) use a "Hx.xx_Ly.yy" type of format, with the numbers being unique identifiers to particular variable chain sequences. Thus, an Fv domain of the antigen binding domain is "H1 L1", which indicates that the variable heavy domain, H1, was combined with the light domain L1. In the case that these sequences are used as scFvs, the designation "H1 L1", indicates that the variable heavy domain, H1 is combined with the light domain, L1, and is in VH-linker-VL orientation, from N- to C-terminus. This molecule with the identical sequences of the heavy and light variable domains but in the reverse order (VL-linker-VH orientation, from N- to C-terminus) would be designated "L1_H1.1". Similarly, different constructs may "mix and match" the heavy and light chains as will be evident from the sequence listing and the figures.

Additionally, the bispecific antibodies of the invention are referred to herein as "anti-CD3×anti-CLDN6", "αCD3×αCLDN6", "αCLDN6×αCD3" or sometimes just "CLDN6×CD3". The order of the antigens is not determinative as will be discussed below, although the majority of the formats that utilize as scFv have the an anti-CD3 ABD as the scFv.

III. Definitions

In order that the application may be more completely understood, several definitions are set forth below. Such definitions are meant to encompass grammatical equivalents.

By "CLDN6" herein is meant a protein belonging to the claudin family. CLDN6 sequences are depicted, for example, in FIG. 11. The ABDs of the invention bind to human CLDN6.

By "ablation" herein is meant a decrease or removal of activity. Thus for example, "ablating FcγR binding" means the Fc region amino acid variant has less than 50% starting binding as compared to an Fc region not containing the specific variant, with more than 70-80-90-95-98% loss of activity being preferred, and in general, with the activity being below the level of detectable binding in a Biacore, SPR or BLI assay. Of particular use in the ablation of FcγR binding are those shown in FIG. 3, which generally are added to both monomers.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific phagocytic cells that express FcγRs recognize bound antibody on a target cell and subsequently cause phagocytosis of the target cell.

As used herein, term "antibody" is used generally. Antibodies described herein can take on a number of formats as described herein, including traditional antibodies as well as antibody derivatives, fragments and mimetics, including a number of bispecific formats described herein.

Traditional immunoglobulin (Ig) antibodies are "Y" shaped tetramers. Each tetramer is typically composed of two identical pairs of polypeptide chains, each pair having one "light chain" monomer (typically having a molecular weight of about 25 kDa) and one "heavy chain" monomer (typically having a molecular weight of about 50-70 kDa).

Other useful antibody formats include, but are not limited to, the 1+1 Fab-scFv-Fc format and 2+1 Fab-scFv-Fc antibody formats described herein, as well as "mAb-Fv," "mAb-scFv," "central-Fv", "one-armed scFv-mAb," "scFv-mAb," "dual scFv," and "trident" format antibodies, as discussed below.

Antibody heavy chains typically include a variable heavy (VH) domain, which includes vhCDR1-3, and an Fc domain, which includes a CH2-CH3 monomer. In some embodiments, antibody heavy chains include a hinge and CH1 domain. Traditional antibody heavy chains are monomers that are organized, from N- to C-terminus: VH-CH1-hinge-CH2-CH3. The CH1-hinge-CH2-CH3 is collectively referred to as the heavy chain "constant domain" or "constant region" of the antibody, of which there are five different categories or "isotypes": IgA, IgD, IgG, IgE and IgM. Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the antibodies described herein include the use of human IgG1/G2 hybrids.

In some embodiments, the antibodies provided herein include IgG isotype constant domains, which has several subclasses, including, but not limited to IgG1, IgG2, IgG3, and IgG4. In the IgG subclass of immunoglobulins, there are several immunoglobulin domains in the heavy chain. By "immunoglobulin (Ig) domain" herein is meant a region of an immunoglobulin having a distinct tertiary structure. Of interest in the antibodies described herein are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype. It should be understood that therapeutic antibodies can also comprise hybrids of isotypes and/or subclasses. For example, as shown in US Publication 2009/0163699, incorporated by reference, the present antibodies, in some embodiments, include IgG1/IgG2 hybrids.

By "Fc" or "Fc region" or "Fc domain" as used herein is meant the polypeptide comprising the constant region of an antibody, in some instances, excluding all of the first constant region immunoglobulin domain (e.g., CH1) or a portion thereof, and in some cases, optionally including all or part of the hinge. For IgG, the Fc domain comprises immunoglobulin domains CH2 and CH3 (Cγ2 and Cγ3), and optionally all or a portion of the hinge region between CH1 (Cγ1) and CH2 (Cγ2). Thus, in some cases, the Fc domain includes, from N- to C-terminal, CH2-CH3 and hinge-CH2-CH3. In some embodiments, the Fc domain is that from human IgG1, IgG2, IgG3 or IgG4, with human IgG1 hinge-CH2-CH3 and IgG4 hinge-CH2-CH3 finding particular use in many embodiments. Additionally, in the case of human IgG1 Fc domains, frequently the hinge includes a C220S amino acid substitution. Furthermore, in the case of human IgG4 Fc domains, frequently the hinge includes a S228P amino acid substitution. Although the boundaries of the Fc region may vary, the human IgG heavy chain Fc region is usually defined to include residues E216, C226, or A231 to its carboxyl-terminal, wherein the numbering is according to the EU index as in Kabat. In some embodiments, as is more fully described below, amino acid modifications are made to the Fc region, for example to alter binding to one or more FcγR or to the FcRn.

By "heavy chain constant region" herein is meant the CH1-hinge-CH2-CH3 portion of an antibody (or fragments thereof), excluding the variable heavy domain; in EU numbering of human IgG1 this is amino acids 118-447 By "heavy chain constant region fragment" herein is meant a heavy chain constant region that contains fewer amino acids from either or both of the N- and C-termini but still retains the ability to form a dimer with another heavy chain constant region.

Another type of Ig domain of the heavy chain is the hinge region. By "hinge" or "hinge region" or "antibody hinge region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (p230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well. Many of the antibodies herein have at least one the cysteines at position 220 according to EU numbering (hinge region) replaced by a serine. Generally, this modification is on the "scFv monomer" side for most of the sequences depicted herein, although it can also be on the "Fab monomer" side, or both, to reduce disulfide formation. Specifically included within the sequences herein are one or both of these cysteines replaced (C220S).

As will be appreciated by those in the art, the exact numbering and placement of the heavy constant region domains can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

|  | EU Numbering | Kabat Numbering |
| --- | --- | --- |
| CH1 | 118-215 | 114-223 |
| Hinge | 216-230 | 226-243 |
| CH2 | 231-340 | 244-360 |
| CH3 | 341-447 | 361-478 |

The antibody light chain generally comprises two domains: the variable light domain (VL), which includes light chain CDRs vlCDR1-3, and a constant light chain region (often referred to as CL or $C_\kappa$. The antibody light chain is typically organized from N- to C-terminus: VL-CL.

By "antigen binding domain" or "ABD" herein is meant a set of six Complementary Determining Regions (CDRs) that, when present as part of a polypeptide sequence, specifically binds a target antigen (e.g., CLDN6 or CD3) as discussed herein. As is known in the art, these CDRs are generally present as a first set of variable heavy CDRs (vhCDRs or VHCDRs) and a second set of variable light CDRs (vlCDRs or VLCDRs), each comprising three CDRs: vhCDR1, vhCDR2, vhCDR3 variable heavy CDRs and vlCDR1, vlCDR2 and vlCDR3 vhCDR3 variable light CDRs. The CDRs are present in the variable heavy domain (vhCDR1-3) and variable light domain (vlCDR1-3). The variable heavy domain and variable light domain from an Fv region.

The antibodies described herein provide a large number of different CDR sets. In this case, a "full CDR set" comprises the three variable light and three variable heavy CDRs, e.g., a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g., vhCDR1, vhCDR2 and vhCDR3) and the disclosure of each variable light region is a disclosure of the vlCDRs (e.g., vlCDR1, vlCDR2 and vlCDR3). A useful comparison of CDR numbering is as below, see Lafranc et al., Dev. Comp. Immunol. 27(1):55-77 (2003):

TABLE 2

|  | Kabat + Chothia | IMGT | Kabat | AbM | Chothia | Contact | Xencor |
| --- | --- | --- | --- | --- | --- | --- | --- |
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

The CDRs contribute to the formation of the antigen-binding, or more specifically, epitope binding site of the antigen binding domains and antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the disclosure not only includes the enumerated antigen binding domains and antibodies herein, but those that compete for binding with the epitopes bound by the enumerated antigen binding domains.

In some embodiments, the six CDRs of the antigen binding domain are contributed by a variable heavy and a variable light domain. In a "Fab" format, the set of 6 CDRs are contributed by two different polypeptide sequences, the variable heavy domain (vh or VH; containing the vhCDR1, vhCDR2 and vhCDR3) and the variable light domain (vl or VL; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker (a "scFv linker") as outlined herein, into a single polypeptide sequence, which can be either (starting from the N-terminus) vh-linker-vl or vl-linker-vh, with the former being generally preferred (including optional domain linkers on each side, depending on the format used (e.g., from FIG. 36). In general, the C-terminus of the scFv domain is attached to the N-terminus of the hinge in the second monomer.

By "variable region" or "variable domain" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively, and contains the CDRs that confer antigen specificity. Thus, a "variable heavy domain" pairs with a "variable light domain" to form an antigen binding domain ("ABD"). In addition, each variable domain comprises three hypervariable regions ("complementary determining regions," "CDRs") (VHCDR1, VHCDR2 and VHCDR3 for the variable heavy domain and VLCDR1, VLCDR2 and VLCDR3 for the variable light domain) and four framework (FR) regions, arranged from amino-terminus to carboxy-terminus in the following order: FR1-CDR1-FR2-CDR2-FR3-CDR3-FR4. The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described in Table 2.

By "Fab" or "Fab region" as used herein is meant the polypeptide that comprises the VH, CH1, VL, and CL immunoglobulin domains, generally on two different polypeptide chains (e.g. VH-CH1 on one chain and VL-CL on the other). Fab may refer to this region in isolation, or this region in the context of a bispecific antibody described herein. In the context of a Fab, the Fab comprises an Fv region in addition to the CH1 and CL domains.

By "Fv" or "Fv fragment" or "Fv region" as used herein is meant a polypeptide that comprises the VL and VH domains of an ABD. Fv regions can be formatted as both Fabs (as discussed above, generally two different polypeptides that also include the constant regions as outlined above) and scFvs, where the VL and VH domains are combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (VH-linker-VL or VL-linker-VH). In the sequences depicted in the sequence listing and in the figures, the order of the VH and VL domain is indicated in the name, e.g. H.X_L.Y means N- to C-terminal is VH-linker-VL, and L.Y_H.X is VL-linker-VH.

Some embodiments of the subject antibodies provided herein comprise at least one scFv domain, which, while not naturally occurring, generally includes a variable heavy domain and a variable light domain, linked together by a scFv linker. As outlined herein, while the scFv domain is generally from N- to C-terminus oriented as VH-scFv linker-VL, this can be reversed for any of the scFv domains (or those constructed using vh and vl sequences from Fabs), to VL-scFv linker-VH, with optional linkers at one or both ends depending on the format.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233– or E233#, E233( ) or E233del designates a deletion of glutamic acid at position 233. Additionally, EDA233– or EDA233# designates a deletion of the sequence GluAspAla that begins at position 233.

By "variant protein" or "protein variant", or "variant" as used herein is meant a protein that differs from that of a parent protein by virtue of at least one amino acid modification. The protein variant has at least one amino acid modification compared to the parent protein, yet not so many that the variant protein will not align with the parental protein using an alignment program such as that described below. In general, variant proteins (such as variant Fc domains, etc., outlined herein, are generally at least 75, 80, 85, 90, 91, 92, 93, 94, 95, 96, 97, 98 or 99% identical to the parent protein, using the alignment programs described below, such as BLAST. "Variant" as used herein also refers to particular amino acid modifications that confer particular function (e.g., a "heterodimerization variant," "pI variant," "ablation variant," etc.).

As described below, in some embodiments the parent polypeptide, for example an Fc parent polypeptide, is a human wild-type sequence, such as the heavy constant domain or Fc region from IgG1, IgG2, IgG3 or IgG4, although human sequences with variants can also serve as "parent polypeptides", for example the IgG1/2 hybrid of US Publication 2006/0134105 can be included. The protein variant sequence herein will preferably possess at least about 80% identity with a parent protein sequence, and most preferably at least about 90% identity, more preferably at least about 95-98-99% identity. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain as compared to an Fc domain of human IgG1, IgG2 or IgG4.

"Fc variant" or "variant Fc" as used herein is meant a protein comprising an amino acid modification in an Fc domain. The modification can be an addition, deletion, or substitution. The Fc variants are defined according to the amino acid modifications that compose them. Thus, for example, N434S or 434S is an Fc variant with the substitution for serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as 434S/428L, and so on. For all positions discussed herein that relate to antibodies or derivatives and fragments thereof (e.g., Fc domains), unless otherwise noted, amino acid position numbering is according to the EU index. The "EU index" or "EU index as in Kabat" or "EU numbering" scheme refers to the numbering of the EU antibody (Edelman et al., 1969, Proc Natl Acad Sci USA 63:78-85, hereby entirely incorporated by reference).

In general, variant Fc domains have at least about 80, 85, 90, 95, 97, 98 or 99 percent identity to the corresponding parental human IgG Fc domain (using the identity algorithms discussed below, with one embodiment utilizing the BLAST algorithm as is known in the art, using default parameters). Alternatively, the variant Fc domains can have from 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Alternatively, the variant Fc domains can have up to 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Additionally, as discussed herein, the variant Fc domains described herein still retain the ability to form a dimer with another Fc domain as measured using known techniques as described herein, such as non-denaturing gel electrophoresis.

By "protein" herein is meant at least two covalently attached amino acids, which includes proteins, polypeptides, oligopeptides and peptides. In addition, polypeptides that make up the antibodies described herein may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the human IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRT (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life. An "FcRn variant" is one that increases binding to the FcRn receptor, and suitable FcRn variants are shown below.

By "parent polypeptide" as used herein is meant a starting polypeptide that is subsequently modified to generate a variant. The parent polypeptide may be a naturally occurring polypeptide, or a variant or engineered version of a naturally occurring polypeptide. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below. In this context, a "parent Fc domain" will be relative to the recited variant; thus, a "variant human IgG1 Fc domain" is compared to the parent Fc domain of human IgG1, a "variant human IgG4 Fc domain" is compared to the parent Fc domain human IgG4, etc.

By "position" as used herein is meant a location in the sequence of a protein. Positions may be numbered sequentially, or according to an established format, for example the EU index for antibody numbering.

By "target antigen" as used herein is meant the molecule that is bound specifically by the antigen binding domain comprising the variable regions of a given antibody.

By "strandedness" in the context of the monomers of the heterodimeric antibodies described herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer one set of the pair will go, such that pI separation is maximized using the pI of the skews as well.

By "target cell" as used herein is meant a cell that expresses a target antigen.

By "host cell" in the context of producing a bispecific antibody according to the antibodies described herein is meant a cell that contains the exogeneous nucleic acids encoding the components of the bispecific antibody and is capable of expressing the bispecific antibody under suitable conditions. Suitable host cells are discussed below.

By "wild type or WT" herein is meant an amino acid sequence or a nucleotide sequence that is found in nature, including allelic variations. A WT protein has an amino acid sequence or a nucleotide sequence that has not been intentionally modified.

Provided herein are a number of antibody domains that have sequence identity to human antibody domains. Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, C D. (1970) "A General Method Applicable To The Search For Similarities In The Amino Acid Sequence Of Two Proteins," J. Mol. Biol. 48:443 [homology alignment algorithm], Pearson, W. R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see https://blast.ncbi.nlm.nih.gov/Blast.cgi. When using any of the aforementioned algorithms, the default parameters (for Window length, gap penalty, etc.) are used. In one embodiment, sequence identity is done using the BLAST algorithm, using default parameters The antibodies described herein are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogenous host cells, and they can be isolated as well.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore, SPR or BLI assay.

IV. Antibodies of the Invention

The present invention provides antibodies, including monoclonal antibodies and bispecific antibodies, that bind to human CLDN6 (it should be noted that many, if not most, of the exemplified antibodies also bind to cyno CLDN6 for ease of pre-clinical testing, but this is not required in all embodiments). In particularly, bispecific antibodies are provided that bind CD3 and CLDN6 that make take on a variety of formats as more fully described below.

Of particular interest are anti-CLDN6 antigen binding domains (and antibodies containing them) that preferentially bind CLDN6 over CLDN9.

1. Antibodies

The antibodies provided herein include different antibody domains as is more fully described below. As described herein and known in the art, the antibodies described herein include different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

In particular, the formats depicted in FIGS. 17 and 36 are usually referred to as "heterodimeric antibodies", meaning that the protein has at least two associated Fc sequences self-assembled into a heterodimeric Fc domain and at least two Fv regions, whether as Fabs or as scFvs.

a. Chimeric and Humanized Antibodies

In certain embodiments, the antibodies described herein comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody (using the methods outlined herein). A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants described herein). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants described herein). In some embodiments, the amino acid differences are in one or more of the 6 CDRs. In some embodiments, the amino acid differences are in a VH and/or VL framework region.

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

2. Heterodimeric Antibodies

In exemplary embodiments, the bispecific antibodies provided herein are heterodimeric bispecific antibodies that include two variant Fc domain sequences. Such variant Fc domains include amino acid modifications to facilitate the self-assembly and/or purification of the heterodimeric antibodies.

An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in biasing the formation of the desired heterodimeric antibody over the formation of the homodimers and/or purifying the heterodimeric antibody away from the homodimers.

There are a number of mechanisms that can be used to generate the subject heterodimeric antibodies. In addition, as will be appreciated by those in the art, these different mechanisms can be combined to ensure high heterodimerization. Amino acid modifications that facilitate the production and purification of heterodimers are collectively referred to generally as "heterodimerization variants." As discussed below, heterodimerization variants include "skew" variants (e.g., the "knobs and holes" and the "charge pairs" variants described below) as well as "pI variants," which allow purification of heterodimers from homodimers. As is generally described in U.S. Pat. No. 9,605,084, hereby incorporated by reference in its entirety and specifically as below for the discussion of heterodimerization variants, useful mechanisms for heterodimerization include "knobs and holes" ("KIH") as described in U.S. Pat. No. 9,605,084, "electrostatic steering" or "charge pairs" as described in U.S. Pat. No. 9,605,084, pI variants as described in U.S. Pat. No. 9,605,084, and general additional Fc variants as outlined in U.S. Pat. No. 9,605,084 and below.

Heterodimerization variants that are useful for the formation and purification of the subject heterodimeric antibody (e.g., bispecific antibodies) are further discussed in detailed below.

a. Skew Variants

In some embodiments, the heterodimeric antibody includes skew variants which are one or more amino acid modifications in a first Fc domain (A) and/or a second Fc domain (B) that favor the formation of Fc heterodimers (Fc dimers that include the first and the second Fc domain; A-B) over Fc homodimers (Fc dimers that include two of the first Fc domain or two of the second Fc domain; A-A or B-B). Suitable skew variants are included in the FIG. 29 of US Publ. App. No. 2016/0355608, hereby incorporated by reference in its entirety and specifically for its disclosure of skew variants, as well as in FIG. 1.

Thus, suitable Fc heterodimerization variant pairs that will permit the formation of heterodimeric Fc regions are shown in FIG. 1. Thus a first Fc domain has first Fc heterodimerization variants and the second Fc domain has second Fc heterodimerization variants selected from the pairs in FIG. 1.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

In some embodiments, the skew variants advantageously and simultaneously favor heterodimerization based on both the "knobs and holes" mechanism as well as the "electrostatic steering" mechanism. In some embodiments, the heterodimeric antibody includes one or more sets of such heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other. That is, these pairs of sets may instead form an interface between the two monomers that encourages heterodimer formation and discourages homodimer formation, allowing the percentage of heterodimers that spontaneously form under biological conditions to be over 90%, rather than the expected 50% (25% homodimer A/A:50% heterodimer A/B:25% homodimer B/B). Exemplary heterodimerization "skew" variants are depicted in FIG. 1. Such "skew" variants include, but are not limited to: S364K/E357Q:L368D/K370S; L368D/K370S:S364K; L368E/K370S:S364K; T411T/E360E/Q362E:D401K; L368D/K370S:S364K/E357L; K370S:S364K/E357Q (EU numbering).

In exemplary embodiments, the heterodimeric antibody includes Fc heterodimerization variants as sets: S364K/E357Q:L368D/K370S; L368D/K370S:S364K; L368E/K370S:S364K; T411T/E360E/Q362E:D401K; L368D/K370S:S364K/E357L; K370S:S364K/E357Q; or a T366S/L368A/Y407V:T366W (optionally including a bridging disulfide, T366S/L368A/Y407V/Y349C:T366W/S354C) are all "skew" variant amino acid substitution sets of Fc heterodimerization variants. In an exemplary embodiment, the heterodimeric antibody includes a "S364K/E357Q:L368D/K370S" amino acid substitution set. In terms of nomenclature, the pair "S364K/E357Q:L368D/K370S" means that one of the monomers includes an Fc domain that includes the amino acid substitutions S364K and E357Q and the other monomer includes an Fc domain that includes the amino acid substitutions L368D and K370S; as above, the "strandedness" of these pairs depends on the starting pI.

In some embodiments, the skew variants provided herein can be optionally and independently incorporated with any other modifications, including, but not limited to, other skew variants (see, e.g., in FIG. 37 of US Publ. App. No. 2012/0149876, herein incorporated by reference, particularly for its disclosure of skew variants), pI variants, isotypic variants, FcRn variants, ablation variants, etc. into one or both of the first and second Fc domains of the heterodimeric antibody. Further, individual modifications can also independently and optionally be included or excluded from the subject the heterodimeric antibody.

Additional monomer A and monomer B variants that can be combined with other variants, optionally and independently in any amount, such as pI variants outlined herein or other steric variants that are shown in FIG. 37 of US 2012/0149876, the figure and legend and SEQ ID NOs of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the antibodies described herein.

A list of suitable skew variants is found in FIG. 1. Of particular use in many embodiments are the pairs of sets including, but not limited to, S364K/E357Q:L368D/K370S; L368D/K370S:S364K; L368E/K370S:S364K; T411T/E360E/Q362E:D401K; L368D/K370S:S364K/E357L and K370S:S364K/E357Q. In terms of nomenclature, the pair "S364K/E357Q:L368D/K370S" means that one of the monomers has the double variant set S364K/E357Q and the other has the double variant set L368D/K370S.

b. pI (Isoelectric Point) Variants for Heterodimers

In some embodiments, the heterodimeric antibody includes purification variants that advantageously allow for the separation of heterodimeric antibody (e.g., anti-CLDN6×anti-CD3 bispecific antibody) from homodimeric proteins.

There are several basic mechanisms that can lead to ease of purifying heterodimeric antibodies. For example, modifications to one or both of the antibody heavy chain monomers A and B such that each monomer has a different pI allows for the isoelectric purification of heterodimeric A-B antibody from monomeric A-A and B-B proteins. Alternatively, some scaffold formats, such as the "1+1 Fab-scFv-Fc" format and the "2+1 Fab$_2$-scFv-Fc" format, also allows separation on the basis of size. As described above, it is also possible to "skew" the formation of heterodimers over homodimers using skew variants. Thus, a combination of heterodimerization skew variants and pI variants find particular use in the heterodimeric antibodies provided herein.

Additionally, as more fully outlined below, depending on the format of the heterodimeric antibody, pI variants either contained within the constant region and/or Fc domains of a monomer, and/or domain linkers can be used. In some embodiments, the heterodimeric antibody includes additional modifications for alternative functionalities that can also create pI changes, such as Fc, FcRn and KO variants.

In some embodiments, the subject heterodimeric antibodies provided herein include at least one monomer with one or more modifications that alter the pI of the monomer (i.e., a "pI variant"). In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Depending on the format of the heterodimer antibody, pI variants can be either contained within the constant and/or Fc domains of a monomer, or charged linkers, either domain linkers or scFv linkers, can be used. That is, antibody formats that utilize scFv(s) such as "1+1 Fab-scFv-Fc", format can include charged scFv linkers (either positive or negative), that give a further pI boost for purification purposes. As will be appreciated by those in the art, some 1+1 Fab-scFv-Fc formats are useful with just charged scFv linkers and no additional pI adjustments, although the antibodies described herein do provide pI variants that are on one or both of the monomers, and/or charged domain linkers as well. In addition, additional amino acid engineering for alternative functionalities may also confer pI changes, such as Fc, FcRn and KO variants.

In subject heterodimeric antibodies that utilizes pI as a separation mechanism to allow the purification of heterodimeric proteins, amino acid variants are introduced into one or both of the monomer polypeptides. That is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g., a neutral amino acid is replaced by a positively or negatively charged amino acid residue, e.g., glycine to glutamic acid), changing a charged residue from positive or negative to the opposite charge (aspartic acid to lysine) or changing a charged residue to a neutral residue (e.g., loss of a charge; lysine to serine). A number of these variants are shown in the FIGS. 1 and 2.

Thus, in some embodiments, the subject heterodimeric antibody includes amino acid modifications in the constant regions that alter the isoelectric point (pI) of at least one, if not both, of the monomers of a dimeric protein to form "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the antibodies described herein.

As will be appreciated by those in the art, the number of pI variants to be included on each or both monomer(s) to get good separation will depend in part on the starting pI of the components, for example in the 1+1 Fab-scFv-Fc and 2+1 Fab$_2$-scFv-Fc formats, the starting pI of the scFv and Fab(s) of interest. That is, to determine which monomer to engineer or in which "direction" (e.g., more positive or more negative), the Fv sequences of the two target antigens are calculated and a decision is made from there. As is known in the art, different Fvs will have different starting pIs which are exploited in the antibodies described herein. In general, as outlined herein, the pIs are engineered to result in a total pI difference of each monomer of at least about 0.1 logs, with 0.2 to 0.5 being preferred as outlined herein.

In the case where pI variants are used to achieve heterodimerization, by using the constant region(s) of the heavy chain(s), a more modular approach to designing and purifying bispecific proteins, including antibodies, is provided. Thus, in some embodiments, heterodimerization variants (including skew and pI heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g., the minimization or avoidance of non-human residues at any particular position. Alternatively or in addition to isotypic substitutions, the possibility of immunogenicity resulting from the pI variants is significantly reduced by utilizing isosteric substitutions (e.g. Asn to Asp; and Gln to Glu).

As discussed below, a side benefit that can occur with this pI engineering is also the extension of serum half-life and increased FcRn binding. That is, as described in US Publ. App. No. US 2012/0028304 (incorporated by reference in its entirety), lowering the pI of antibody constant domains (including those found in antibodies and Fc fusions) can lead to longer serum retention in vivo. These pI variants for increased serum half-life also facilitate pI changes for purification.

In addition, it should be noted that the pI variants give an additional benefit for the analytics and quality control process of bispecific antibodies, as the ability to either eliminate, minimize and distinguish when homodimers are present is significant. Similarly, the ability to reliably test the reproducibility of the heterodimeric antibody production is important.

In general, embodiments of particular use rely on sets of variants that include skew variants, which encourage heterodimerization formation over homodimerization formation, coupled with pI variants, which increase the pI difference between the two monomers to facilitate purification of heterodimers away from homodimers.

Figure 30:
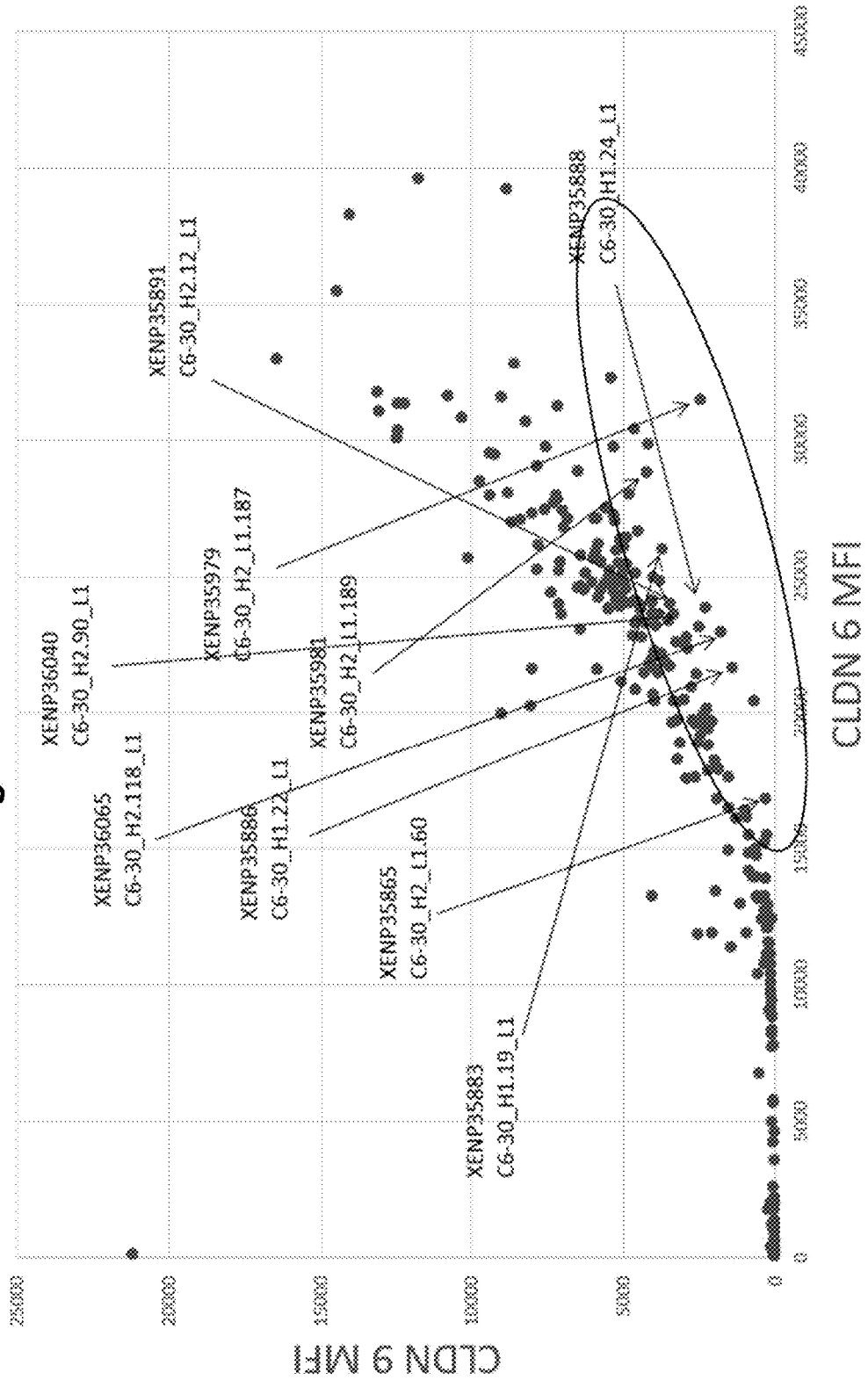
FIG. 30 depicts the binding of variants from a single point mutation library of humanized C6-30 to 293 cells expressing CLDN6 or CLDN9. Each point on the plot represents a test article which was screened for binding at a single dose (30 ug/ml) to CLDN6 and CLDN9 and then analyzed with flow cytometry to obtain an MFI value. Test articles that skewed toward higher CLDN6 MFI values and lower CLDN9 MFI values, such as those circled on the scatter plot, were selected for further development.

Exemplary combinations of pI variants are shown in FIGS. 4 and 5, and FIG. 30 of US Publ. App. No. 2016/0355608, all of which are herein incorporated by reference in its entirety and specifically for the disclosure of pI variants. Preferred combinations of pI variants are shown in FIGS. 1 and 2. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including (GKPGS)$_4$ (SEQ ID NO: 1). However, as will be appreciated by those in the art, the first monomer includes a CH1 domain, including position 208. Accordingly, in constructs that do not include a CH1 domain (for example for antibodies that do not utilize a CH1 domain on one of the domains), a preferred negative pI variant Fc set includes 295E/384D/418E/421D variants (Q295E/N384D/Q418E/N421D when relative to human IgG1).

Accordingly, in some embodiments, one monomer has a set of substitutions from FIG. 2 and the other monomer has a charged linker (either in the form of a charged scFv linker because that monomer comprises an scFv or a charged domain linker, as the format dictates, which can be selected from those depicted in FIG. 5).

In some embodiments, modifications are made in the hinge of the Fc domain, including positions 216, 217, 218, 219, 220, 221, 222, 223, 224, 225, 226, 227, 228, 229, and 230 based on EU numbering. Thus, pI mutations and particularly substitutions can be made in one or more of positions 216-230, with 1, 2, 3, 4 or 5 mutations finding use. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 233, 234, 235, 236, 274, 296, 300, 309, 320, 322, 326, 327, 334 and 339, based on EU numbering. It should be noted that changes in 233-236 can be made to increase effector function (along with 327A) in the IgG2 backbone. Again, all possible combinations of these 14 positions can be made; e.g., =may include a variant Fc domain with 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non-native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non-native threonine at position 339, and all possible combinations within CH2 and with other domains.

In this embodiment, the modifications can be independently and optionally selected from position 355, 359, 362, 384, 389,392, 397, 418, 419, 444 and 447 (EU numbering) of the CH3 region. Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non-native glutamic acid at position 419, a non-native glutamic acid at position 359, a non-native glutamic acid at position 362, a non-native glutamic acid at position 389, a non-native glutamic acid at position 418, a non-native glutamic acid at position 444, and a deletion or non-native aspartic acid at position 447.

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 2. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, for example in the FIG. 36 formats, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including (GKPGS)$_4$ (SEQ ID NO: 1). However, as will be appreciated by those in the art, the first monomer includes a CH1 domain, including position 208. Accordingly, in constructs that do not include a CH1 domain (for example for antibodies that do not utilize a CH1 domain on one of the domains, for example in a dual scFv format or a "one-armed" format such as those depicted in FIG. 36B, C or D), a preferred negative pI variant Fc set includes 295E/384D/418E/421D variants (Q295E/N384D/Q418E/N421D when relative to human IgG1).

Accordingly, in some embodiments, one monomer has a set of substitutions from FIG. 4 and the other monomer has a charged linker (either in the form of a charged scFv linker because that monomer comprises an scFv or a charged domain linker, as the format dictates, which can be selected from those depicted in FIG. 5).

c. Isotypic Variants

In addition, many embodiments of the antibodies described herein rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

d. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

e. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, —7.4, induces the release of Fc back into the blood. In mice, Dall'Acqua et al. showed that Fc mutants with increased FcRn binding at pH 6 and pH 7.4 actually had reduced serum concentrations and the same half-life as wild-type Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

f. Additional Fc Variants for Additional Functionality

In addition to the heterodimerization variants discussed above, there are a number of useful Fc amino acid modification that can be made for a variety of reasons, including, but not limited to, altering binding to one or more FcγR receptors, altered binding to FcRn receptors, etc., as discussed below.

Accordingly, the antibodies provided herein (heterodimeric, as well as homodimeric) can include such amino acid modifications with or without the heterodimerization variants outlined herein (e.g., the pI variants and steric variants). Each set of variants can be independently and optionally included or excluded from any particular heterodimeric protein.

(i) FcγR Variants

Accordingly, there are a number of useful Fc substitutions that can be made to alter binding to one or more of the FcγR receptors. In certain embodiments, the subject antibody includes modifications that alter the binding to one or more FcγR receptors (i.e., "FcγR variants"). Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the antibodies described herein include those listed in U.S. Pat. No. 8,188,321 (particularly FIG. 41) and U.S. Pat. No. 8,084,582, and US Publ. App. Nos. 20060235208 and 20070148170, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D/332E/330L, 243A, 243L, 264A, 264V and 299T.

In addition, there are additional Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 428L/434A, 259I/308F, 436I/428L, 436I or V/434S, 436V/428L and 259I/308F/428L. Such modification may be included in one or both Fc domains of the subject antibody.

(ii) Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, in many embodiments, particularly in the use of bispecific antibodies that bind CD3 monovalently it is generally desirable to ablate FcγRIIIa binding to eliminate or significantly reduce ADCC activity. Wherein one of the Fc domains comprises one or more Fcγ receptor ablation variants. These ablation variants are depicted in FIG. 3, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

As is known in the art, the Fc domain of human IgG1 has the highest binding to the Fcγ receptors, and thus ablation variants can be used when the constant domain (or Fc domain) in the backbone of the heterodimeric antibody is IgG1. Alternatively, or in addition to ablation variants in an IgG1 background, mutations at the glycosylation position 297 (generally to A or S) can significantly ablate binding to FcγRIIIa, for example. Human IgG2 and IgG4 have naturally reduced binding to the Fcγ receptors, and thus those backbones can be used with or without the ablation variants.

B. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In some embodiments, the heterodimeric antibodies provided herein include the combination of heterodimerization skew variants, isosteric pI substitutions and FcKO variants as depicted in FIG. 4. In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

Exemplary combination of variants that are included in some embodiments of the heterodimeric 1+1 Fab-scFv-Fc and 2+1 Fab₂-scFv-Fc format antibodies are included in FIG. 4. In certain embodiments, the antibody is a heterodimeric 1+1 Fab-scFv-Fc or 2+1 Fab₂-scFv-Fc format antibody as shown in FIGS. 17A and 17B.

C. Anti-CLDN6×Anti-CD3 Bispecific Antibodies

In another aspect, provided herein are anti-CLDN6×anti-CD3 (also referred to herein as "αCLDN6×αCD3") bispecific antibodies. Such antibodies include at least one CLDN6 binding domain and at least one CD3 binding domain. In some embodiments, bispecific αCLDN6×αCD3 provided herein immune responses selectively in tumor sites that express CLDN6.

Note that unless specified herein, the order of the antigen list in the name does not confer structure; that is a CLDN6×CD3 1+1 Fab-scFv-Fc antibody can have the scFv bind to CLDN6 or CD3, although in some cases, the order specifies structure as indicated.

As is more fully outlined herein, these combinations of ABDs can be in a variety of formats, as outlined below, generally in combinations where one ABD is in a Fab format and the other is in an scFv format. Exemplary formats that are used in the bispecific antibodies provided herein include the 1+1 Fab-scFv-Fc and 2+1 Fab2-scFv-Fv formats (see, e.g., FIGS. 17A and 17B). Other useful antibody formats include, but are not limited to, "mAb-Fv," "mAb-scFv," "central-Fv", "one-armed scFv-mAb," "scFv-mAb," "dual scFv," and "trident" format antibodies, as depicted in FIG. 36 and more fully described below.

In addition, in general, one of the ABDs comprises a scFv as outlined herein, in an orientation from N- to C-terminus of VH-scFv linker-VL or VL-scFv linker-VH. One or both of the other ABDs, according to the format, generally is a Fab, comprising a VH domain on one protein chain (generally as a component of a heavy chain) and a VL on another protein chain (generally as a component of a light chain).

As will be appreciated by those in the art, any set of 6 CDRs or VH and VL domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIG. 5.

In addition, as discussed above, the numbering used in the Sequence Listing for the identification of the CDRs is Kabat, however, different numbering can be used, which will change the amino acid sequences of the CDRs as shown in Table 2.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 90, 95 or 99% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 90, 95 or 99% identity to a human germline sequence selected from those listed in FIG. 1 of U.S. Pat. No. 7,657,380. Alternatively, the CDRs can have amino acid modifications (e.g., from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g., there may be one change in vlCDR1, two in vhCDR2, none in vhCDR3, etc.)), as well as having framework region changes, as long as the framework regions retain at least 80, 85 90, 95 or 99% identity to a human germline sequence selected from those listed in FIG. 1 of U.S. Pat. No. 7,657,380.

As discussed herein, the subject heterodimeric antibodies include two antigen binding domains (ABDs), each of which bind to CLDN6 or CD3. As outlined herein, these heterodimeric antibodies can be bispecific and bivalent (each antigen is bound by a single ABD, for example, in the format depicted in FIG. 17A), or bispecific and trivalent (one antigen is bound by a single ABD and the other is bound by two ABDs, for example as depicted in FIG. 17B).

In addition, in general, one of the ABDs comprises a scFv as outlined herein, in an orientation from N- to C-terminus of VH-scFv linker-VL or VL-scFv linker-VH. One or both of the other ABDs, according to the format, generally is a Fab, comprising a VH domain on one protein chain (generally as a component of a heavy chain) and a VL on another protein chain (generally as a component of a light chain).

The disclosure provides a number of ABDs as outlined below. As will be appreciated by those in the art, any set of 6 CDRs or VH and VL domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIG. 5.

In addition, as discussed above, the numbering used in the Sequence Listing for the identification of the CDRs is Kabat, however, different numbering can be used, which will change the amino acid sequences of the CDRs as shown in Table 2.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 90, 95 or 99% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 90, 95 or 99% identity to a human germline sequence selected from those listed in FIG. 1 of U.S. Pat. No. 7,657,380. Alternatively, the CDRs can have amino acid modifications (e.g. from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g. there may be one change in VLCDR1, two in VHCDR2, none in VHCDR3, etc.)), as well as having framework region changes, as long as the framework regions retain at least 80, 85 90, 95 or 99% identity to a human germline sequence selected from those listed in FIG. 1 of U.S. Pat. No. 7,657,380.

1. CLDN6 Antigen Binding Domains

Herein is provided monoclonal and bispecific antibodies (e.g., the anti-CLDN6×anti-CD3 antibodies provided herein), and fusion proteins that contain antigen binding domains that bind to human CLDN6. Suitable sets of 6 CDRs and/or VH and VL domains are depicted in FIGS. 13, 14, 15 and 18. In some embodiments, the heterodimeric antibody is a 1+1 Fab-scFv-Fc or 2+1 Fab2-scFv-Fv format antibody (see, e.g., FIGS. 17A and 17B) although any of the formats outlined below can be utilized.

In some embodiments, the CLDN6 ABD has a set of vhCDRs selected from the vhCDR1, vhCDR2 and vhCDR3 sequences from a VH selected from the group consisting of H1, H1.1, H1.2, H1.3, H1.4, H1.5, H1.6, H1.7, H1.8, H1.9, H1.19, H1.22, H1.24, H2, H2.1, H2.2, H2.3, H2.4, H2.5, H2.6, H2.7, H2.8, H2.9, H2.11, H2.12, H2.71, H2.75, H2.90, H2.91, H2.118 and H2.119, see FIGS. 14 and 15.

In some embodiments, the VH domain of the CLDN6 ABD is selected from the group consisting of H1, H1.1, H1.2, H1.3, H1.4, H1.5, H1.6, H1.7, H1.8, H1.9, H1.19, H1.22, H1.24, H2, H2.1, H2.2, H2.3, H2.4, H2.5, H2.6, H2.7, H2.8, H2.9, H2.11, H2.12, H2.71, H2.75, H2.90, H2.91, H2.118 and H2.119, see FIGS. 14 and 15.

In some embodiments, the CLDN6 ABD has a set of vlCDRs selected from the vlCDR1, vlCDR2 and vlCDR3 sequences from a VL selected from the group consisting of L1, L1.1, L1.4, L1.7, L1.16, L1.18, L1.19, L1.21, L1.22, L1.23, L1.27, L1.60, L1.107, L1.114, L1.187, L1.189 and L2, see FIGS. 14 and 15.

In some embodiments, the VL of the CLDN6 ABD is selected from the group consisting of L1, L1.1, L1.4, L1.7, L1.16, L1.7, L1.16, L1.18, L1.19, L1.21, L1.22, L1.23, L1.27, L1.60, L1.107, L1.114, L1.187, L1.189 and L2, see FIGS. 14 and 15.

Accordingly, included herein are CLDN6 ABDs that have a set of 6 CDRs (vhCDR1, vhCDR2, vhCDR3, vlCDR1, vlCDR2 and vlCDR3) from VH/VL pairs selected from the group consisting of: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9, L1.4_H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1_L1.16, H1.2_L1.16, H1.3_L1.16, H1.4 L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1_L1.16, H2.2_L1.16, H2.3_L1.16, H2.4 L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5 L1.18, H1.6_L1.18, H1.7_L1.18, H1.8_L1.18, H1.9_L1.18, H1.19_L1.18, H1.22_L1.18, H1.24_L1.18, H2.1_L1.18, H2.2_L1.18, H2.3_L1.18, H2.4_L1.18, H2.5 L1.18, H2.6_L1.18, H2.7_L1.18, H2.8_L1.18, H2.9_L1.18, H2.11_L1.18, H2.12_L1.18, H2.71_L1.18, H2.75_L1.18, H2.90_L1.18, H2.91_L1.18, H2.118_L1.18, H2.119 L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H1.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2.

Additionally, included herein are CLDN6 ABDs that have VH/VL pairs selected from the group consisting of: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9, L1.4_H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1_L1.16, H1.2 L1.16, H1.3_L1.16, H1.4_L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1_L1.16, H2.2 L1.16, H2.3_L1.16, H2.4_L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5_L1.18, H1.6_L1.18, H1.7_L1.18, H1.8_L1.18, H1.9 L1.18, H1.19_L1.18, H1.22_L1.18, H1.24_L1.18, H2_L1.18, H2.1_L1.18, H2.2_L1.18, H2.3_L1.18, H2.4_L1.18, H2.5_L1.18, H2.6_L1.18, H2.7_L1.18, H2.8_L1.18, H2.9 L1.18, H2.11_L1.18, H2.12_L1.18, H2.71_L1.18, H2.75_L1.18, H2.90_L1.18, H2.91_L1.18, H2.118_L1.18, H2.119_L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H2.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2.

In particular embodiments, the VH/VL pairs are selected from the group consisting of H1.9_L1.187, H1.24_L1.187, H2.91_L1.187 and H1.9_L1.187.

In particular embodiments, the VH/VL pairs are Fabs and are selected from the group consisting of H1.9_L1.187, H1.24_L1.187, H2.91_L1.187 and H1.9_L1.187.

As will be appreciated by those in the art, suitable CLDN6 binding domains can comprise a set of 6 CDRs as depicted in the Figures, either as they are underlined or, in the case where a different numbering scheme is used as described herein and as shown in Table 2, as the CDRs that are identified using other alignments within the VH and VL sequences of those depicted in FIGS. 13, 14 and 15. Suitable ABDs can also include the entire VH and VL sequences as depicted in these sequences and Figures, used as scFvs or as Fabs. In many of the embodiments herein that contain an Fv to CLDN6, it is the Fab monomer that binds CLDN6.

In addition to the parental CDR sets disclosed in the figures and sequence listing that form an ABD to CLDN6, provided herein are variant CLDN6 ABDs having CDRs that include at least one modification of the CLDN6 ABD CDRs disclosed herein (e.g., (FIGS. 13-15 and 18 and the sequence listing). In one embodiment, the CLDN6 ABD of the subject heterodimeric antibody includes a set of 6 CDRs with 1, 2, 3, 4, 5, 6, 7, 8, 9, 10 amino acid modifications as compared to the 6 CDRs of a CLDN6 binding domain VH/VL pair as described herein, including the figures and sequence listing. In exemplary embodiments, the CLDN6 ABD of the subject heterodimeric antibody includes a set of 6 CDRs with 1, 2, 3, 4, 5, 6, 7, 8, 9, 10 amino acid modifications as compared to the 6 CDRs of one of the following CLDN6 binding domain VH/VL pairs: H1.9_L1.187, H1.24_L1.187, H2.91_L1.187 and H1.9_L1.187. In certain embodiments, the CLDN6 ABD of the subject antibody is capable of binding to CLDN6, as measured at least one of a Biacore, surface plasmon resonance (SPR), BLI (biolayer interferometry, e.g., Octet assay) assay, and/or flow cytometry, with the latter finding particular use in many embodiments. In particular embodiments, the CLDN6 ABD is capable of binding human CLDN6 (see FIG. 11). In some cases, each variant CDR has no more than 1 or 2 amino acid changes, with no more than 1 per CDR being particularly useful.

In some embodiments, the CLDN6 ABD of the subject antibody includes 6 CDRs that are at least 90, 95, 97, 98 or 99% identical to the 6 CDRs of a CLDN6 ABD as described herein, including the figures and sequence listing. In exemplary embodiments, the CLDN6 ABD of the subject antibody includes 6 CDRs that are at least 90, 95, 97, 98 or 99% identical to the 6 CDRs of one of the following CLDN6 binding domain VH/VL pairs: H1.9_L1.187, H1.24_L1.187, H2.91_L1.187 and H1.9_L1.187). In certain embodiments, the CLDN6 ABD of the subject antibody is capable of binding to CLDN6, as measured at least one of a Biacore, surface plasmon resonance (SPR), BLI (biolayer interferometry, e.g., Octet assay) assay, and/or flow cytometry, with the latter finding particular use in many embodiments. In particular embodiments, the CLDN6 ABD is capable of binding human CLDN6 antigen (see FIG. 11).

In another exemplary embodiment, the CLDN6 ABD of the subject antibody includes the variable heavy (VH) domain and variable light (VL) domain of any one of the CLDN6 binding domain VH/VL pairs described herein, including the figures and sequence listing.

In some embodiments, the subject antibody includes a CLDN6 ABD that includes a variable heavy domain and/or a variable light domain that are variants of a CLDN6 ABD VH and VL domain disclosed herein. In one embodiment, the variant VH domain and/or VL domain has from 1, 2, 3, 4, 5, 6, 7, 8, 9 or 10 amino acid changes from a VH and/or VL domain of a CLDN6 ABD described herein, including the figures and sequence listing. In exemplary embodiments, the variant VH domain and/or VL domain has from 1, 2, 3, 4, 5, 6, 7, 8, 9 or 10 amino acid changes from a VH and/or VL domain of one of the following CLDN6 binding domain VH/VL pairs: H1.9_L1.187, H1.24_L1.187, H2.91_L1.187 and H1.9_L1.187. In some embodiments, the changes are in a VH domain depicted in FIGS. 13-15 and 18. In some embodiments, the changes are in a VL domain are depicted in FIGS. 13-15 and 18. In some embodiments, the changes are in a VH and VL domain are depicted in FIGS. 13-15 and 18. In some embodiments, one or more amino acid changes are in the VH and/or VL framework regions (FR1, FR2, FR3, and/or FR4). In some embodiments, one or more amino acid changes are in one or more CDRs. In certain embodiments, the CLDN6 ABD of the subject antibody is capable of binding to CLDN6, as measured at least one of a Biacore, surface plasmon resonance (SPR), BLI (biolayer interferometry, e.g., Octet assay) assay, and/or flow cytometry, with the latter finding particular use in many embodiments. In particular embodiments, the CLDN6 ABD is capable of binding human CLDN6 antigen (see FIG. 11).

In one embodiment, the variant VH and/or VL domain is at least 90, 95, 97, 98 or 99% identical to the VH and/or VL of a CLDN6 ABD as described herein, including the figures and sequence listing. In exemplary embodiments, the variant VH and/or VL domain is at least 90, 95, 97, 98 or 99% identical to the VH and/or VL of one of the following CLDN6 binding domain VH/VL pairs: H1.9_L1.187, H1.24_L1.187, H2.91_L1.187 and H1.9_L1.187. In some embodiments, the CLDN6 ABD includes a VH that is at least 90, 95, 97, 98 or 99% identical to VH domain depicted in FIGS. 13-15 and 18. In some embodiments, the CLDN6 ABD includes a VL that is at least 90, 95, 97, 98 or 99% identical to VL domain depicted in FIGS. 13-15 and 18. In some embodiments, the CLDN6 ABD includes a VH and a VL that is at least 90, 95, 97, 98 or 99% identical to a VH domain and a VL domain depicted in FIGS. 13-15 and 18. In certain embodiments, the CLDN6 ABD of the subject antibody is capable of binding to CLDN6, as measured at least one of a Biacore, surface plasmon resonance (SPR), BLI (biolayer interferometry, e.g., Octet assay) assay, and/or flow cytometry, with the latter finding particular use in many embodiments. In particular embodiments, the CLDN6 ABD is capable of binding human CLDN6 antigen (see FIG. 11).

2. CD3 Antigen Binding Domains

The heterodimeric bispecific of the invention (e.g., anti-CLDN6×anti-CD3 antibodies) also include an ABD that binds to human episilon CD3 (CDR).

Suitable sets of 6 CDRs and/or VH and VL domains, as well as scFv sequences, are depicted in FIG. 10. CD3 binding domain sequences that are of particular use include, but are not limited to, anti-CD3_H1.30_L1.47, anti-CD3_H1.32_L1.47, anti-CD3 H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3_L1.47_H1.90, anti-CD3_L1.47_H1.33, and anti-CD3_L1.47_H1.31 as depicted in FIG. 10. As shown in FIG. 10, when the anti-CD3 ABD is a scFv domain, the VH and VL domains can be in either orientation.

As will be appreciated by those in the art, suitable CD3 binding domains can comprise a set of 6 CDRs as depicted in FIG. 10, either as they are underlined or, in the case where a different numbering scheme is used as described herein and as shown in Table 2, as the CDRs that are identified using other alignments within the VH and VL sequences of those depicted in FIGS. 10A-10F. Suitable ABDs can also include the entire VH and VL sequences as depicted in these sequences and Figures, used as scFvs or as Fabs. In many of the embodiments herein that contain an Fv to CD3, it is the scFv monomer that binds CD3.

In addition to the parental CDR sets disclosed in the figures and sequence listing that form an ABD to CD3, provided herein are variant CD3 ABDS having CDRs that include at least one modification of the CD3 ABD CDRs disclosed herein (e.g., (FIG. 10 and the sequence listing). In one embodiment, the CD3 ABD of the subject heterodimeric antibody (e.g., anti-CLDN6×anti-CD3 antibody) includes a set of 6 CDRs with 1, 2, 3, 4, 5, 6, 7, 8, 9, 10 amino acid modifications as compared to the 6 CDRs of a CD3 ABD as described herein, including the figures and sequence listing. In exemplary embodiments, the CD3 ABD of the subject heterodimeric antibody includes a set of 6 CDRs with 1, 2, 3, 4, 5, 6, 7, 8, 9, 10 amino acid modifications as compared to the 6 CDRs of one of the following CD3 binding domains: anti-CD3_H1.30_L1.47, anti-CD3_H1.32_L1.47, anti-CD3 H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3_L1.47_H1.90, anti-CD3_L1.47_H1.33, and anti-CD3_L1.47_H1.31 (FIG. 10). In certain embodiments, the CD3 ABD of the subject antibody is capable of binding CD3 antigen, as measured by at least one of a Biacore, surface plasmon resonance (SPR), flow cytometry, and/or BLI (biolayer interferometry, e.g., Octet assay) assay, with the latter finding particular use in many embodiments. In particular embodiments, the CD3ABD is capable of binding human CD3.

In some embodiments, the CD3 ABD of the subject antibody includes 6 CDRs that are at least 90, 95, 97, 98 or 99% identical to the 6 CDRs of a CD3 ABD as described herein, including the figures and sequence listing. In exemplary embodiments, the CD3 ABD of the subject antibody includes 6 CDRs that are at least 90, 95, 97, 98 or 99% identical to the 6 CDRs of one of the following CD3 binding domains: anti-CD3_H1.30_L1.47, anti-CD3 H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti- CD3_L1.47_H1.90, anti-CD3_L1.47_H1.33, and anti-CD3 L1.47_H1.31 (FIG. 10). In certain embodiments, the CD3 ABD is capable of binding to the CD3, as measured by at least one of a Biacore, surface plasmon resonance (SPR), flow cytometry, and/or BLI (biolayer interferometry, e.g., Octet assay) assay, with the latter finding particular use in many embodiments. In particular embodiments, the CD3 ABD is capable of binding human CD3 antigen.

In another exemplary embodiment, the CD3 ABD of the subject antibody includes the variable heavy (VH) domain and variable light (VL) domain of any one of the CD3 binding domains described herein, including the figures and sequence listing.

In some embodiments, the subject antibody includes a CD3 ABD that includes a variable heavy domain and/or a variable light domain that are variants of a CD3 ABD VH and VL domain disclosed herein. In one embodiment, the variant VH domain and/or VL domain has from 1, 2, 3, 4, 5, 6, 7, 8, 9 or 10 amino acid changes from a VH and/or VL domain of a CD3 ABD described herein, including the figures and sequence listing. In exemplary embodiments, the variant VH domain and/or VL domain has from 1, 2, 3, 4, 5, 6, 7, 8, 9 or 10 amino acid changes from a VH and/or VL domain of one of the following CD3 binding domains: anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3 L1.47_H1.30, anti-CD3_L1.47_H1.30, anti-CD3_L1.47_H1.32, anti-CD3_L1.47_H1.89, anti-CD3_L1.47_H1.90, anti-CD3_L1.47_H1.33, and anti-CD3_L1.47_H1.31 (FIG. 10). In some embodiments, the changes are in a VH domain depicted in FIG. 10. In some embodiments, the changes are in a VL domain are depicted in FIG. 10. In some embodiments, the changes are in a VH and VL domain are depicted in FIG. 10. In some embodiments, one or more amino acid changes are in the VH and/or VL framework regions (FR1, FR2, FR3, and/or FR4). In some embodiments, one or more amino acid changes are in one or more CDRs. In certain embodiments, the CD3 ABD of the subject antibody is capable of binding to CD3, as measured at least one of a Biacore, surface plasmon resonance (SPR), flow cytometry, and/or BLI (biolayer interferometry, e.g., Octet assay) assay, with the latter finding particular use in many embodiments. In particular embodiments, the CD3 ABD is capable of binding human CD3 antigen.

In one embodiment, the variant VH and/or VL domain is at least 90, 95, 97, 98 or 99% identical to the VH and/or VL of a CD3 ABD as described herein, including the figures and sequence listing. In exemplary embodiments, the variant VH and/or VL domain is at least 90, 95, 97, 98 or 99% identical to the VH and/or VL of one of the following CD3 binding domains: anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3 L1.47_H1.30, anti-CD3_L1.47_H1.30, anti-CD3_L1.47_H1.32, anti-CD3_L1.47_H1.89, anti-CD3_L1.47_H1.90, anti-CD3_L1.47_H1.33, and anti-CD3_L1.47_H1.31 (FIG. 10). In some embodiments, the CD3 ABD includes a VH that is at least 90, 95, 97, 98 or 99% identical to VH domain depicted in FIG. 10. In some embodiments, the CD3 ABD includes a VL that is at least 90, 95, 97, 98 or 99% identical to VL domain depicted in FIG. 10. In some embodiments, the CD3 ABD includes a VH and a VL that is at least 90, 95, 97, 98 or 99% identical to a VH domain and a VL domain depicted in FIG. 10. In certain embodiments, the CD3 ABD is capable of binding to CD3, as measured by at least one of a Biacore, surface plasmon resonance (SPR), flow cytometry, and/or BLI (biolayer interferometry, e.g., Octet assay) assay, with the latter finding particular use in many embodiments. In particular embodiments, the CD3 ABD is capable of binding human CD3 antigen.

In addition to the αCD3 ABDs of FIG. 10, additional ABDs of use in the invention include those depicted in FIGS. 14 and 15 of WO2014/145806, hereby expressly incorporated herein in their entirety including the Figures and Legends therein.

3. Linkers

As shown herein, there are a number of suitable linkers (for use as either domain linkers or scFv linkers) that can be used to covalently attach the recited domains (e.g., scFvs, Fabs, Fc domains, etc.), including traditional peptide bonds, generated by recombinant techniques. Exemplary linkers to attach domains of the subject antibody to each other are depicted in FIG. 6. In some embodiments, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 3), (GGGGS)n (SEQ ID NO: 2), and (GGGS)n (SEQ ID NO: 4), where n is an integer of at least one (and generally from 3 to 4), glycine-alanine polymers, alanine-serine polymers, and other flexible linkers, some of which are shown in FIG. 5 and FIG. 6. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example $C_\kappa$ or $C_\lambda$. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

In some embodiments, the linker is a "domain linker", used to link any two domains as outlined herein together. For example, in FIG. 17B, there may be a domain linker that attaches the C-terminus of the CH1 domain of the Fab to the N-terminus of the scFv, with another optional domain linker attaching the C-terminus of the scFv to the CH2 domain (although in many embodiments the hinge is used as this domain linker). While any suitable linker can be used, many embodiments utilize a glycine-serine polymer as the domain linker, including for example (GS)n, (GSGGS)n (SEQ ID NO: 3), (GGGGS)n (SEQ ID NO: 2), and (GGGS)n (SEQ ID NO: 4), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used. Exemplary useful domain linkers are depicted in FIG. 6.

With particular reference to the domain linker used to attach the scFv domain to the Fc domain in the "2+1" format, there are several domain linkers that find particular use, including "full hinge C220S variant," "flex half hinge," "charged half hinge 1," and "charged half hinge 2" as shown in FIG. 6.

In some embodiments, the linker is a "scFv linker", used to covalently attach the VH and VL domains as discussed herein. In many cases, the scFv linker is a charged scFv linker, a number of which are shown in FIG. 5. Accordingly, in some embodiments, the antibodies described herein further provide charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make 1+1 Fab-scFv-Fc format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the antibodies described herein as well, and thus those included in FIG. 5 can be used in any embodiment herein where a linker is utilized.

D. Useful Formats of the Invention

As will be appreciated by those in the art and discussed more fully below, the heterodimeric bispecific antibodies provided herein can take on a wide variety of configurations, as are generally depicted in FIG. 17 as well as FIG. 36. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Thus, in some embodiments, the antibodies described herein are directed to novel immunoglobulin compositions that co-engage a different first and a second antigen.

As will be appreciated by those in the art, the heterodimeric formats of the antibodies described herein can have different valencies as well as be bispecific. That is, heterodimeric antibodies of the antibodies described herein can be bivalent and bispecific, wherein one target tumor antigen (e.g. CD3) is bound by one binding domain and the other target tumor antigen (e.g. CLDN6) is bound by a second binding domain. The heterodimeric antibodies can also be trivalent and bispecific, wherein the first antigen is bound by two binding domains and the second antigen by a second binding domain. As is outlined herein, when CD3 is one of the target antigens, it is preferable that the CD3 is bound only monovalently, to reduce potential side effects.

The antibodies described herein utilize anti-CD3 antigen binding domains in combination with anti-CLDN6 binding domains. As will be appreciated by those in the art, any collection of anti-CD3 CDRs, anti-CD3 variable light and variable heavy domains, Fabs and scFvs as described herein, and depicted in any of the Figures can be used. Similarly, any of the anti-CLDN6 antigen binding domains can be used, whether CDRs, variable light and variable heavy domains, Fabs and scFvs as described herein, and depicted in any of the Figures can be used, optionally and independently combined in any combination.

1. 1+1 Fab-scFv-Fc Format

One heterodimeric scaffold that finds particular use in the antibodies described herein is the "1+1 Fab-scFv-Fc" or "bottle-opener" format as shown in FIG. 17A with an exemplary combination of a CD3 binding domain and a tumor target antigen (CLDN6) binding domain. In this embodiment, one heavy chain monomer of the antibody contains a single chain Fv ("scFv", as defined below) and an Fc domain. The scFv includes a variable heavy domain (VH1) and a variable light domain (VL1), wherein the VH1 is attached to the VL1 using an scFv linker that can be charged (see, e.g., FIG. 5). The scFv is attached to the heavy chain using a domain linker (see, e.g., FIG. 6). The other heavy chain monomer is a "regular" heavy chain (VH-CH1-hinge-CH2-CH3). The 1+1 Fab-scFv-Fc also includes a light chain that interacts with the VH-CH1 to form a Fab. This structure is sometimes referred to herein as the "bottle-opener" format, due to a rough visual similarity to a bottle-opener. The two heavy chain monomers are brought together by the use of amino acid variants (e.g., heterodimerization variants, discussed above) in the constant regions (e.g., the Fc domain, the CH1 domain and/or the hinge region) that promote the formation of heterodimeric antibodies as is described more fully below.

There are several distinct advantages to the present "1+1 Fab-scFv-Fc" format. As is known in the art, antibody analogs relying on two scFv constructs often have stability and aggregation problems, which can be alleviated in the antibodies described herein by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.).

Many of the embodiments outlined herein rely in general on the 1+1 Fab-scFv-Fc or "bottle opener" format antibody that comprises a first monomer comprising an scFv, comprising a variable heavy and a variable light domain, covalently attached using an scFv linker (charged, in many but not all instances), where the scFv is covalently attached to the N-terminus of a first Fc domain usually through a domain linker The domain linker can be either charged or uncharged and exogenous or endogenous (e.g., all or part of the native hinge domain). Any suitable linker can be used to attach the scFv to the N-terminus of the first Fc domain. In some embodiments, the domain linker is chosen from the domain linkers in FIG. 6. The second monomer of the 1+1 Fab-scFv-Fc format or "bottle opener" format is a heavy chain, and the composition further comprises a light chain.

In general, in many preferred embodiments, the scFv is the domain that binds to the CD3, and the Fab forms an CLDN6 binding domain. An exemplary anti-CLDN6×anti-CD3 bispecific antibody in the 1+1 Fab-scFv-Fc format is depicted in FIG. 17A. Exemplary anti-CLDN6×anti-CD3 bispecific antibodies in the 1+1 Fab-scFv-Fc format are depicted in FIGS. 19 and 20.

In addition, the Fc domains of the antibodies described herein generally include skew variants (e.g. a set of amino acid substitutions as shown in FIG. 1, with particularly useful skew variants being selected from the group consisting of S364K/E357Q:L368D/K370S; L368D/K370S:

S364K; L368E/K370S:S364K; T411T/E360E/Q362E: D401K; L368D/K370S:S364K/E357L; K370S:S364K/ E357Q; T366S/L368A/Y407V:T366W and T366S/L368A/ Y407V/Y349C:T366W/S354C), optionally ablation variants (including those shown in FIG. 3), optionally charged scFv linkers (including those shown in FIG. 5) and the heavy chain comprises pI variants (including those shown in FIG. 2).

In certain embodiments, the 1+1 Fab-scFv-Fc scaffold format includes a first monomer that includes a scFv-domain linker-CH2-CH3 monomer, a second monomer that includes a first variable heavy domain-CH1-hinge-CH2-CH3 monomer and a third monomer that includes a first variable light domain. In some embodiments, the CH2-CH3 of the first monomer is a first variant Fc domain and the CH2-CH3 of the second monomer is a second variant Fc domain. In some embodiments, the scFv includes a scFv variable heavy domain and a scFv variable light domain that form a CD3 binding moiety. In certain embodiments, the scFv variable heavy domain and scFv variable light domain are covalently attached using an scFv linker (charged, in many but not all instances. See, e.g., FIG. 5). In some embodiments, the first variable heavy domain and first variable light domain form a CLDN6 binding domain.

In some embodiments, the 1+1 Fab-scFv-Fc format includes skew variants, pI variants, and ablation variants. Accordingly, some embodiments include 1+1 Fab-scFv-Fc formats that comprise: a) a first monomer (the "scFv monomer") that comprises a charged scFv linker (with the +H sequence of FIG. 5 being preferred in some embodiments), the skew variants S364K/E357Q, the ablation variants E233P/L234V/L235A/G236del/S267K, and an scFv that binds to CD3 as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain; and c) a light chain that includes a variable light domain light domain (VL) and a constant light domain (CL), wherein numbering is according to EU numbering. The variable heavy domain and variable light domain make up an CLDN6 binding moiety.

Any suitable CD3 ABD can be included in the 1+1 Fab-scFv-Fc format antibody, included those provided herein. CD3 binding domain sequences finding particular use in these embodiments include, but are not limited to, H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31 or a variant thereof, as well as those depicted in FIG. 10 and those depicted in FIGS. 14 and 15 of WO2014/145806, hereby incorporated by reference including the Legends.

Any suitable CLDN6 ABD can be included in the 1+1 Fab-scFv-Fc format antibody, included those provided herein. CLDN6 ABDs that are of particular use in these embodiments include, but are not limited to, VH and VL domains selected from have VH/VL pairs selected from the group consisting of: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9, L1.4_H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1_L1.16, H1.2 L1.16, H1.3_L1.16, H1.4_L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1_L1.16, H2.2 L1.16, H2.3_L1.16, H2.4_L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5_L1.18, H1.6_L1.18, H1.7_L1.18, H1.8_L1.18, H1.9 L1.18, H1.19_L1.18, H1.22_L1.18, H1.24_L1.18, H2_L1.18, H2.1_L1.18, H2.2_L1.18, H2.3_L1.18, H2.4_L1.18, H2.5_L1.18, H2.6_L1.18, H2.7_L1.18, H2.8_L1.18, H2.9 L1.18, H2.11_L1.18, H2.12_L1.18, H2.71_L1.18, H2.75_L1.18, H2.90_L1.18, H2.91 L1.18, H2.118_L1.18, H2.119_L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H1.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2 or a variant thereof.

In particular embodiments, the αCLDN6 ABD VH/VL pairs are selected from the group consisting of H1.9_L1.187, H1.24_L1.187, H2.91_L1.187 and H1.9_L1.187 or a variant thereof.

In some embodiments, the 1+1 Fab-scFv-Fc format includes skew variants, pI variants, ablation variants and FcRn variants. Accordingly, some embodiments include 1+1 Fab-scFv-Fc formats that comprise: a) a first monomer (the "scFv monomer") that comprises a charged scFv linker (with the +H sequence of FIG. 6 being preferred in some embodiments), the skew variants S364K/E357Q, the ablation variants E233P/L234V/L235A/G236del/S267K, the FcRn variants M428L/N434S and an scFv that binds to CD3 as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S, and a variable heavy domain; and c) a light chain that includes a variable light domain (VL) and a constant light domain (CL), wherein numbering is according to EU numbering. The variable heavy domain and variable light domain make up a CLDN6 binding domain. CD3 binding domain sequences finding particular use in these embodiments include, but are not limited to, H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31 or a variant thereof, as well as those depicted in FIG. 10. CLDN6 binding domain sequences that are of particular use in these embodiments include, but are not limited to, the αCLDN6 ABD VH_VL pairs are selected from the group consisting of H1.9_L1.187, H1.24_L1.187, H2.91_L1.187 and H1.9_L1.187 or a variant thereof.

Particularly useful CLDN6 and CD3 sequence combinations for use with the 1+1 format antibody include, for example, are disclosed in FIGS. 19 and 20.

FIGS. 7A-7D show some exemplary Fc domain sequences that are useful in the 1+1 Fab-scFv-Fc format antibodies. The "monomer 1" sequences depicted in FIGS. 7A-7D typically refer to the Fc domain of the "Fab-Fc heavy chain" and the "monomer 2" sequences refer to the Fc domain of the "scFv-Fc heavy chain." Further, FIG. 9 provides useful CL sequences that can be used with this format.

In some embodiments, any of the VH and VL sequences depicted herein (including all VH and VL sequences depicted in the Figures and Sequence Listings, including those directed to CLDN6) can be added to the bottle opener backbone formats of FIG. 7A-7D as the "Fab side", using any of the anti-CD3 scFv sequences shown in the Figures and Sequence Listings.

For bottle opener backbone 1 from FIG. 7A, (optionally including the 428L/434S variants), CD binding domain sequences finding particular use in these embodiments include, but are not limited to, CD3 binding domain anti-CD3_H1.30_L1.47, anti-CD3_H1.32_L1.47, anti-CD3_H1.89_L1.47, anti-CD3_H1.90_L1.47, anti-CD3 H1.33_L1.47 and anti-CD3_H1.31_L1.47 attached as the scFv side of the backbones shown in FIG. 7.

2. mAb-Fv

Figure 36A:
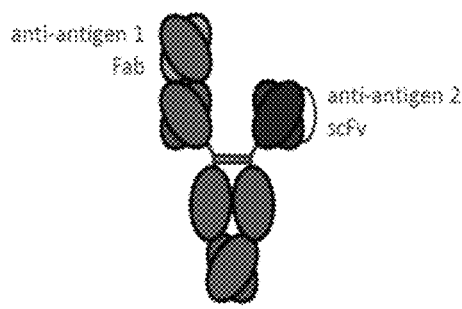
Figure 36B:
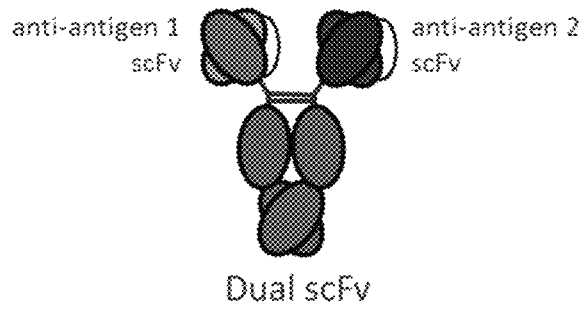
Figure 36C:
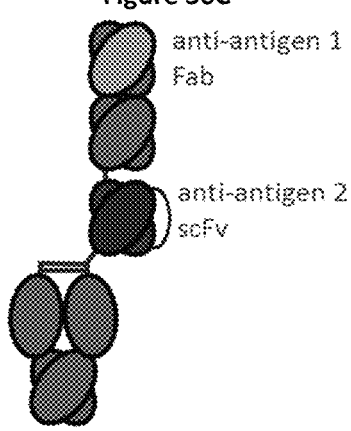
Figure 36D:
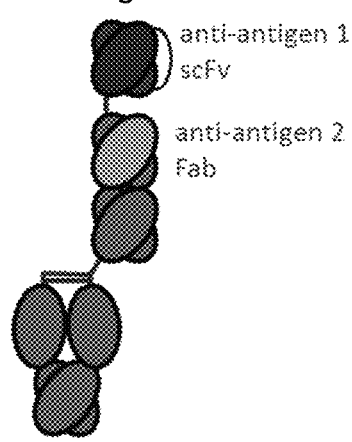
Figure 36E:
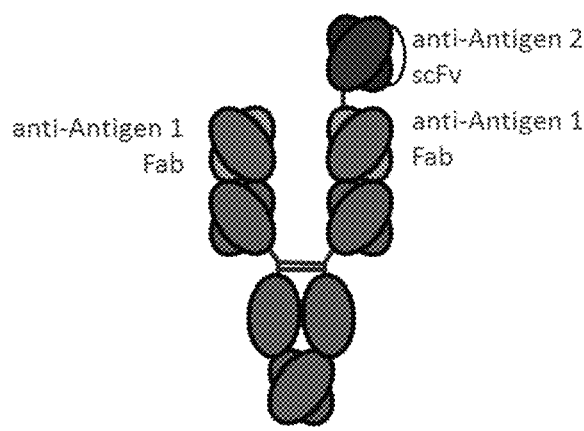
Figure 36F:
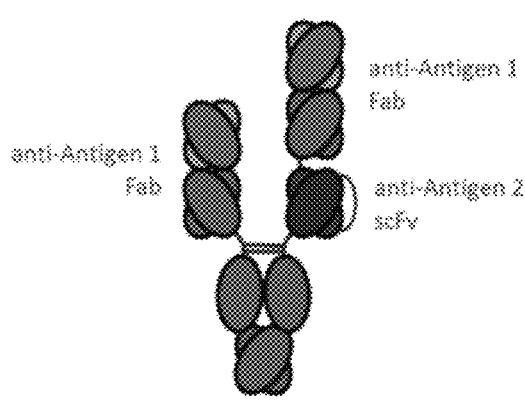
Figure 36G:
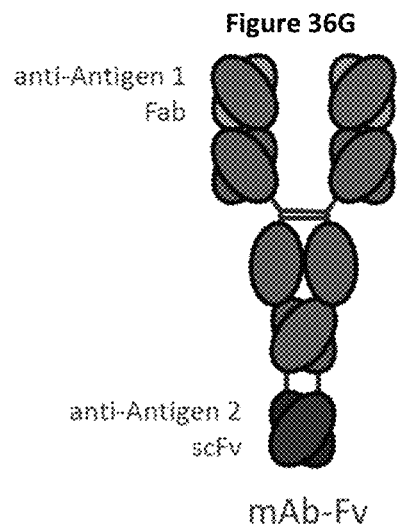

One heterodimeric scaffold that finds particular use in the antibodies described herein is the mAb-Fv format (FIG. 36G). In this embodiment, the format relies on the use of a C-terminal attachment of an "extra" variable heavy domain to one monomer and the C-terminal attachment of an "extra" variable light domain to the other monomer, thus forming a third antigen binding domain, wherein the Fab portions of the two monomers bind a CLDN6 and the "extra" scFv domain binds CD3.

In this embodiment, the first monomer comprises a first heavy chain, comprising a first variable heavy domain and a first constant heavy domain comprising a first Fc domain, with a first variable light domain covalently attached to the C-terminus of the first Fc domain using a domain linker (VH1-CH1-hinge-CH2-CH3-[optional linker]-VL2). The second monomer comprises a second variable heavy domain of the second constant heavy domain comprising a second Fc domain, and a third variable heavy domain covalently attached to the C-terminus of the second Fc domain using a domain linker (vh1-CH1-hinge-CH2-CH3-[optional linker]-VH2. The two C-terminally attached variable domains make up a Fv that binds CD3 (as it is less preferred to have bivalent CD3 binding). This embodiment further utilizes a common light chain comprising a variable light domain and a constant light domain that associates with the heavy chains to form two identical Fabs that bind a CLDN6. As for many of the embodiments herein, these constructs include skew variants, pI variants, ablation variants, additional Fc variants, etc. as desired and described herein.

The antibodies described herein provide mAb-Fv formats where the CD3 binding domain sequences are as shown in FIG. 10 or a variant thereof. The antibodies described herein provide mAb-Fv formats wherein the CLDN6 binding domain sequences are as shown in FIGS. 13, 14 and 15 or a variant thereof.

In addition, the Fc domains of the mAb-Fv format comprise skew variants (e.g. a set of amino acid substitutions as shown in FIG. 1, with particularly useful skew variants being selected from the group consisting of S364K/E357Q: L368D/K370S; L368D/K370S:S364K; L368E/K370S: S364K; T411T/E360E/Q362E:D401K; L368D/K370S: S364K/E357L, K370S:S364K/E357Q, T366S/L368A/Y407V:T366W and T366S/L368A/Y407V/Y349C:T366W/S354C), optionally ablation variants (including those shown in FIG. 3), optionally charged scFv linkers (including those shown in FIG. 5) and the heavy chain comprises pI variants (including those shown in FIG. 2).

In some embodiments, the mAb-Fv format includes skew variants, pI variants, and ablation variants. Accordingly, some embodiments include mAb-Fv formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to CLDN6, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to CLDN6 as outlined herein, and a second variable light chain, that together with the second variable heavy domain forms an Fv (ABD) that binds to CD3; and c) a light chain comprising a first variable light domain and a constant light domain.

In some embodiments, the mAb-Fv format includes skew variants, pI variants, ablation variants and FcRn variants. Accordingly, some embodiments include mAb-Fv formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to CLDN6, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to CLDN6 as outlined herein, and a second variable light chain, that together with the second variable heavy domain of the first monomer forms an Fv (ABD) that binds CD3; and c) a light chain comprising a first variable light domain and a constant light domain.

3. mAb-scFv

Figure 36H:
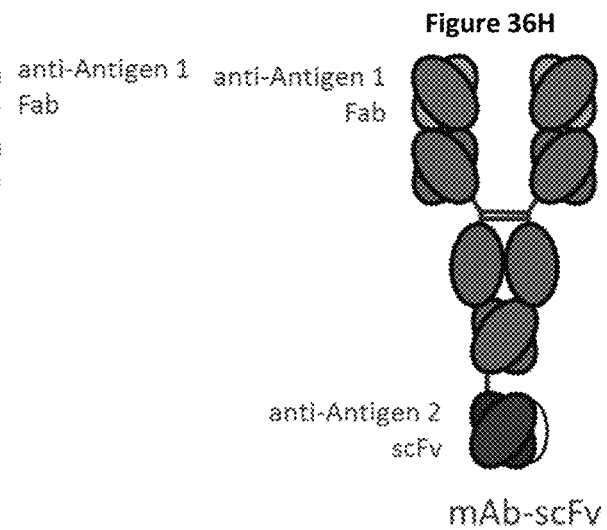

One heterodimeric scaffold that finds particular use in the antibodies described herein is the mAb-scFv format (FIG. 36H). In this embodiment, the format relies on the use of a C-terminal attachment of a scFv to one of the monomers, thus forming a third antigen binding domain, wherein the Fab portions of the two monomers bind CLDN6 and the "extra" scFv domain binds CD3. Thus, the first monomer comprises a first heavy chain (comprising a variable heavy domain and a constant domain), with a C-terminally covalently attached scFv comprising a scFv variable light domain, an scFv linker and a scFv variable heavy domain in either orientation (VH1-CH1-hinge-CH2-CH3-[optional linker]-VH2-scFv linker-VL2 or VH1-CH1-hinge-CH2-CH3-[optional linker]-VL2-scFv linker-VH2). This embodiment further utilizes a common light chain comprising a variable light domain and a constant light domain, that associates with the heavy chains to form two identical Fabs that bind CLDN6. As for many of the embodiments herein, these constructs include skew variants, pI variants, ablation variants, additional Fc variants, etc. as desired and described herein.

The antibodies described herein provide mAb-scFv formats, where the CD3 binding domain sequences are as shown in FIG. 10A-10F or a variant thereof and the CLDN6 binding domain sequences are as shown in FIGS. 13-15 and 18 or a variant thereof.

In addition, the Fc domains of the mAb-scFv format comprise skew variants (e.g. a set of amino acid substitutions as shown in FIG. 1, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 3), optionally charged scFv linkers (including those shown in FIG. 5) and the heavy chain comprises pI variants (including those shown in FIG. 2).

In some embodiments, the mAb-scFv format includes skew variants, pI variants, and ablation variants. Accordingly, some embodiments include mAb-scFv formats that comprise: a) a first monomer that comprises the skew variants S364K/E357Q, the ablation variants E233P/L234V/L235A/G236del/S267K, and a variable heavy domain that, with the variable light domain of the common light chain, makes up an Fv that binds to CLDN6 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with the variable light domain of the common light chain, makes up an Fv that binds to CLDN6 as outlined herein; and c) a common light chain comprising a variable light domain and a constant light domain.

In some embodiments, the mAb-scFv format includes skew variants, pI variants, ablation variants and FcRn variants. Accordingly, some embodiments include mAb-scFv formats that comprise: a) a first monomer that comprises the skew variants S364K/E357Q, the ablation variants E233P/L234V/L235A/G236del/S267K, the FcRn variants M428L/N434S and a variable heavy domain that, with the variable light domain of the common light chain, makes up an Fv that binds to CLDN6 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain of the common light chain, makes up an Fv that binds to CLDN6 as outlined herein; and c) a common light chain comprising a variable light domain and a constant light domain.

4. 2+1 Fab$_2$-scFv-Fc Format

One heterodimeric scaffold that finds particular use in the antibodies described herein is the "2+1 Fab$_2$-scFv-Fc" format (also referred to in previous related filings as "Central-scFv format") shown in FIG. 17B with an exemplary combination of a CD3 binding domain and two tumor target antigen (CLDN6) binding domains. In this embodiment, the format relies on the use of an inserted scFv domain thus forming a third antigen binding domain, wherein the Fab portions of the two monomers bind CLDN6 and the "extra" scFv domain binds CD3. The scFv domain is inserted between the Fc domain and the CH1-Fv region of one of the monomers, thus providing a third antigen binding domain. As described, CLDN6×CD3 bispecific antibodies having the 2+1 Fab$_2$-scFv-Fc format are potent in inducing redirected T cell cytotoxicity in cellular environments that express low levels of CLDN6. Moreover, as shown in the examples, CLDN6×CD3 bispecific antibodies having the 2+1 Fab$_2$-scFv-Fc format allow for the "fine tuning" of immune responses as such antibodies exhibit a wide variety of different properties, depending on the CLDN6 and/or CD3 binding domains used. For example, such antibodies exhibit differences in selectivity for cells with different CLDN6 expression, potencies for CLDN6 expressing cells, ability to elicit cytokine release, and sensitivity to soluble CLDN6. These CLDN6 antibodies find use, for example, in the treatment of CLDN6-associated cancers.

In this embodiment, one monomer comprises a first heavy chain comprising a first variable heavy domain, a CH1 domain (and optional hinge) and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using optional domain linkers (VH1-CH1-[optional linker]-VH2-scFv linker-VL2-[optional linker including the hinge]-CH2-CH3, or the opposite orientation for the scFv, VH1-CH1-[optional linker]-VL2-scFv linker-VH2-[optional linker including the hinge]-CH2-CH3). The optional linkers can be any suitable peptide linkers, including, for example, the domain linkers included in FIG. 6. In some embodiments, the optional linker is a hinge or a fragment thereof. The other monomer is a standard Fab side (i.e., VH1-CH1-hinge-CH2-CH3). This embodiment further utilizes a common light chain comprising a variable light domain and a constant light domain, that associates with the heavy chains to form two identical Fabs that bind CLDN6. As for many of the embodiments herein, these constructs include skew variants, pI variants, ablation variants, additional Fc variants, etc. as desired and described herein.

In one embodiment, the 2+1 Fab$_2$-scFv-Fc format antibody includes an scFv with the VH and VL of a CD3 binding domain sequence depicted in FIG. 10 or a variant thereof. In one embodiment, the 2+1 Fab$_2$-scFv-Fc format antibody includes two Fabs having the VH and VL of a CLDN6 binding domain as shown in FIGS. 13-15 and 18 or a variant thereof.

In exemplary embodiments, the CLDN6 binding domain of the 2+1 Fab$_2$-scFv-Fc CLDN6×CD3 bispecific antibody includes the VH and VL CD3 binding domain sequences finding particular use in these embodiments include, but are not limited to, H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31 or a variant thereof, as well as those depicted in FIG. 10 and those depicted in FIGS. 14 and 15 of WO2014/145806, hereby incorporated by reference including the Legends.

Any suitable CLDN6 ABD can be included in the 2+1 Fab$_2$-scFv-Fc format antibody, included those provided herein. CLDN6 ABDs that are of particular use in these embodiments include, but are not limited to, VH and VL domains selected from the group consisting of: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9, L1.4_H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1_L1.16, H1.2_L1.16, H1.3_L1.16, H1.4 L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1_L1.16, H2.2_L1.16, H2.3_L1.16, H2.4 L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5 L1.18, H1.6_L1.18, H1.7_L1.18, H1.8_L1.18, H1.9_L1.18, H1.19_L1.18, H1.22_L1.18, H1.24_L1.18, H2_L1.18, H2.1_L1.18, H2.2_L1.18, H2.3_L1.18, H2.4_L1.18, H2.5 L1.18, H2.6_L1.18, H2.7_L1.18, H2.8_L1.18, H2.9_L1.18, H2.11_L1.18, H2.12_L1.18, H2.71_L1.18, H2.75_L1.18, H2.90_L1.18, H2.91_L1.18, H2.118_L1.18, H2.119 L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H1.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2.

In particular embodiments, the αCLDN6 ABD VH/VL pairs are selected from the group consisting of H1.9_L1.187, H1.24_L1.187, H2.91_L1.187 and H1.9_L1.187 or a variant thereof.

In addition, the Fc domains of the 2+1 Fab$_2$-scFv-Fc format comprise skew variants (e.g. a set of amino acid substitutions as shown in FIG. 1, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 3), optionally charged scFv linkers (including those shown in FIG. 5) and the heavy chain comprises pI variants (including those shown in FIG. 2).

In some embodiments, the 2+1 Fab$_2$-scFv-Fc format antibody includes skew variants, pI variants, and ablation variants. Accordingly, some embodiments include 2+1 Fab$_2$-scFv-Fc formats that comprise: a) a first monomer (the Fab-scFv-Fc side) that comprises the skew variants S364K/E357Q, the ablation variants E233P/L234V/L235A/G236del/S267K, and a variable heavy domain that, with the variable light domain of the common light chain, makes up an Fv that binds to CLDN6 as outlined herein, and an scFv domain that binds to CD3; b) a second monomer (the Fab-Fc side) that comprises the skew variants L368D/K370S, the pI variants N208D/Q295E/N384D/Q418E/N421D, the ablation variants E233P/L234V/L235A/G236del/S267K, and a variable heavy domain that, with variable light domain of the common light chain, makes up an Fv that binds to CLDN6 as outlined herein; and c) a common light chain comprising the variable light domain and a constant light domain, where numbering is according to EU numbering. In some embodiments, the αCLDN6 VH_VL pairs are selected from the group consisting of H1.9_L1.187, H1.24_L1.187, H2.91_L1.187 and H1.9_L1.187 or a variant thereof.

In some embodiments, the 2+1 Fab$_2$-scFv-Fc format antibody includes skew variants, pI variants, ablation variants and FcRn variants. Accordingly, some embodiments include 2+1 Fab$_2$-scFv-Fc formats that comprise: a) a first monomer (the Fab-scFv-Fc side) that comprises the skew variants S364K/E357Q, the ablation variants E233P/L234V/L235A/G236del/S267K, the FcRn variants M428L/N434S and a variable heavy domain that, with the variable light domain of the common light chain, makes up an Fv that binds to CLDN6 as outlined herein, and an scFv domain that binds to CD3; b) a second monomer (the Fab-Fc side) that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with variable light domain of the common light chain, makes up an Fv that binds to CLDN6 as outlined herein; and c) a common light chain comprising a variable light domain and a constant light domain, where numbering is according to EU numbering. In some embodiments, the αCLDN6 VH_VL pairs are selected from the group consisting of H1.9_L1.187, H1.24_L1.187, H2.91_L1.187 and H1.9_L1.187 or a variant thereof. CD3 binding domain sequences finding particular use in these embodiments include, but are not limited to, H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31 or a variant thereof.

FIGS. 8A-8C shows some exemplary Fc domain sequences that are useful with the 2+1 Fab$_2$-scFv-Fc format. The "monomer 1" sequences depicted in FIGS. 8A-8C typically refer to the Fc domain of the "Fab-Fc heavy chain" and the "monomer 2" sequences refer to the Fc domain of the "Fab-scFv-Fc heavy chain." Further, FIG. 9 provides useful CL sequences that can be used with this format.

Exemplary anti-CLDN6×anti-CD3 2+1 Fab$_2$-scFv-Fc format antibodies are depicted in FIGS. 21, 22, 59 and 60.

5. Central-Fv

Figure 36I:
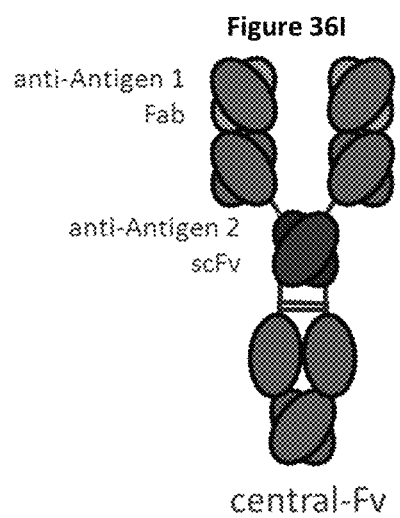

One heterodimeric scaffold that finds particular use in the antibodies described herein is the Central-Fv format (FIG. 36I). In this embodiment, the format relies on the use of an inserted Fv domain (i.e., the central Fv domain) thus forming an "extra" third antigen binding domain, wherein the Fab portions of the two monomers bind a CLDN6 and the "extra" central Fv domain binds CD3. The "extra" central Fv domain is inserted between the Fc domain and the CH1-Fv region of the monomers, thus providing a third antigen binding domain (i.e., the "extra" central Fv domain), wherein each monomer contains a component of the "extra" central Fv domain (i.e., one monomer comprises the variable heavy domain and the other a variable light domain of the "extra" central Fv domain).

In this embodiment, one monomer comprises a first heavy chain comprising a first variable heavy domain, a CH1 domain, and Fc domain and an additional variable light domain. The light domain is covalently attached between the C-terminus of the CH1 domain of the heavy constant domain and the N-terminus of the first Fc domain using domain linkers (VH1-CH1-[optional linker]-VL2-hinge-CH2-CH3). The other monomer comprises a first heavy chain comprising a first variable heavy domain, a CH1 domain and Fc domain and an additional variable heavy domain (VH1-CH1-[optional linker]-VH2-hinge-CH2-CH3). The light domain is covalently attached between the C-terminus of the CH1 domain of the heavy constant domain and the N-terminus of the first Fc domain using domain linkers.

This embodiment further utilizes a common light chain comprising a variable light domain and a constant light domain, that associates with the heavy chains to form two identical Fabs that each bind an CLDN6. As for many of the embodiments herein, these constructs include skew variants, pI variants, ablation variants, additional Fc variants, etc. as desired and described herein.

The antibodies described herein provide central-Fv formats, where the CD3 binding domain sequences are as shown in FIG. 10 or a variant thereof, and the CLDN6 binding domain sequences are as shown in FIGS. 13, 14 and 15 or a variant thereof.

6. One-Armed Central-scFv

One heterodimeric scaffold that finds particular use in the antibodies described herein is the one-armed central-scFv format (FIG. 36C). In this embodiment, one monomer comprises just an Fc domain, while the other monomer includes a Fab domain (a first antigen binding domain), a scFv domain (a second antigen binding domain) and an Fc domain, where the scFv domain is inserted between the Fc domain and the Fc domain. In this format, the Fab portion binds one receptor target and the scFv binds another. In this format, either the Fab portion binds a CLDN6 and the scFv binds CD3 or vice versa.

In this embodiment, one monomer comprises a first heavy chain comprising a first variable heavy domain, a CH1 domain and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using domain linkers, in either orientation, VH1-CH1-[optional domain linker]-VH2-scFv linker-VL2-[optional domain linker]-CH2-CH3 or VH1-CH1-[optional domain linker]-VL2-scFv linker-VH2-[optional domain linker]-CH2-CH3. The second monomer comprises an Fc domain (CH2-CH3). This embodiment further utilizes a light chain comprising a variable light domain and a constant light domain that associates with the heavy chain to form a Fab.

As for many of the embodiments herein, these constructs include skew variants, pI variants, ablation variants, additional Fc variants, etc. as desired and described herein.

The antibodies described herein provide central-Fv formats where the CD3 binding domain sequences are as shown in FIG. 10 or a variant thereof, and the CLDN6 binding domain sequences are as shown in FIGS. 13, 14 and 15 or a variant thereof.

In addition, the Fc domains of the one-armed central-scFv format generally include skew variants (e.g. a set of amino acid substitutions as shown in FIG. 1, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S/S364K/E357Q, T366S/L368A/Y407V:T366W and T366S/L368A/Y407V/Y349C:T366W/S354C), optionally ablation variants (including those shown in FIG. 3), optionally charged scFv linkers (including those shown in FIG. 5) and the heavy chain comprises pI variants (including those shown in FIG. 2).

In some embodiments, the one-armed central-scFv format includes skew variants, pI variants, and ablation variants. Accordingly, some embodiments of the one-armed central-scFv formats comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to CLDN6 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K; and c) a light chain comprising a variable light domain and a constant light domain.

In some embodiments, the one-armed central-scFv format includes skew variants, pI variants, ablation variants and FcRn variants. Accordingly, some embodiments of the one-armed central-scFv formats comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to CLDN6 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K, and the FcRn variants M428L/N434S; and c) a light chain comprising a variable light domain and a constant light domain.

7. One-Armed scFv-mAb

One heterodimeric scaffold that finds particular use in the antibodies described herein is the one-armed scFv-mAb format (FIG. 36D). In this embodiment, one monomer comprises just an Fc domain, while the other monomer uses a scFv domain attached at the N-terminus of the heavy chain, generally through the use of a linker: VH-scFv linker-VL-[optional domain linker]-CH1-hinge-CH2-CH3 or (in the opposite orientation) VL-scFv linker-VH-[optional domain linker]-CH1-hinge-CH2-CH3. In this format, the Fab portions each bind CLDN6 and the scFv binds CD3. This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein.

The antibodies described herein provide one-armed scFv-mAb formats, where the CD3 binding domain sequences are as shown in FIG. 10 or a variant thereof, and wherein the CLDN6 binding domain sequences are as shown in FIGS. 13, 14 and 15 or a variant thereof.

In addition, the Fc domains of the one-armed scFv-mAb format generally include skew variants (e.g. a set of amino acid substitutions as shown in FIG. 1, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 3), optionally charged scFv linkers (including those shown in FIG. 5) and the heavy chain comprises pI variants (including those shown in FIG. 2).

In some embodiments, the one-armed scFv-mAb format includes skew variants, pI variants, and ablation variants. Accordingly, some embodiments of the one-armed scFv-mAb formats comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to CLDN6 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K; and c) a light chain comprising a variable light domain and a constant light domain.

In some embodiments, the one-armed scFv-mAb format includes skew variants, pI variants, ablation variants and FcRn variants. Accordingly, some embodiments one-armed scFv-mAb formats comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to CLDN6 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K, and the FcRn variants M428L/N434S; and c) a light chain comprising a variable light domain and a constant light domain.

8. scFv-mAb

One heterodimeric scaffold that finds particular use in the antibodies described herein is the mAb-scFv format (FIG. 36E). In this embodiment, the format relies on the use of a N-terminal attachment of a scFv to one of the monomers, thus forming a third antigen binding domain, wherein the Fab portions of the two monomers bind CLDN6 and the "extra" scFv domain binds CD3.

In this embodiment, the first monomer comprises a first heavy chain (comprising a variable heavy domain and a constant domain), with a N-terminally covalently attached scFv comprising a scFv variable light domain, an scFv linker and a scFv variable heavy domain in either orientation ((VH1-scFv linker-VL1-[optional domain linker]-VH2-CH1-hinge-CH2-CH3) or (with the scFv in the opposite orientation) ((VL1-scFv linker-VH1-[optional domain linker]-VH2-CH1-hinge-CH2-CH3)). This embodiment further utilizes a common light chain comprising a variable light domain and a constant light domain that associates with the heavy chains to form two identical Fabs that bind CLDN6. As for many of the embodiments herein, these constructs include skew variants, pI variants, ablation variants, additional Fc variants, etc. as desired and described herein.

The antibodies described herein provide scFv-mAb formats, where the CD3 binding domain sequences are as shown in FIG. 10 or a variant thereof, and wherein the CLDN6 binding domain sequences are as shown in FIGS. 13, 14 and 15 or a variant thereof.

In addition, the Fc domains of the scFv-mAb format generally include skew variants (e.g. a set of amino acid substitutions as shown in FIG. 1, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 3), optionally charged scFv linkers (including those shown in FIG. 5) and the heavy chain comprises pI variants (including those shown in FIG. 2).

In some embodiments, the scFv-mAb format includes skew variants, pI variants, and ablation variants. Accordingly, some embodiments include scFv-mAb formats that comprise: a) a first monomer that comprises the skew variants S364K/E357Q, the ablation variants E233P/L234V/L235A/G236del/S267K, and a variable heavy domain that, with the variable light domain of the common light chain, makes up an Fv that binds to CLDN6 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with the variable light domain of the common light chain, makes up an Fv that binds to CLDN6 as outlined herein; and c) a common light chain comprising a variable light domain and a constant light domain.

In some embodiments, the scFv-mAb format includes skew variants, pI variants, ablation variants and FcRn variants. Accordingly, some embodiments include scFv-mAb formats that comprise: a) a first monomer that comprises the skew variants S364K/E357Q, the ablation variants E233P/L234V/L235A/G236del/S267K, the FcRn variants M428L/N434S and a variable heavy domain that, with the variable light domain of the common light chain, makes up an Fv that binds to CLDN6 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain of the common light chain, makes up an Fv that binds to CLDN6 as outlined herein; and c) a common light chain comprising a variable light domain and a constant light domain.

9. Dual scFv Formats

The antibodies described herein also provide dual scFv formats as are known in the art (FIG. 36B). In this embodiment, the CLDN6×CD3 heterodimeric bispecific antibody is made up of two scFv-Fc monomers (both in either (VH-scFv linker-VL-[optional domain linker]-CH2-CH3) format or (VL-scFv linker-VH-[optional domain linker]-CH2-CH3) format, or with one monomer in one orientation and the other in the other orientation.

The antibodies described herein provide dual scFv formats where the CD3 binding domain sequences are as shown in FIG. 10A-10F or a variant thereof, and wherein the CLDN6 binding domain sequences are as shown in FIGS. 13-15 and 18 or a variant thereof. In some embodiments, the dual scFv format includes skew variants, pI variants, and ablation variants. Accordingly, some embodiments include dual scFv formats that comprise: a) a first monomer that comprises the skew variants S364K/E357Q, the ablation variants E233P/L234V/L235A/G236del/S267K, and a first scFv that binds either CD3 or CLDN6; and b) a second monomer that comprises the skew variants L368D/K370S, the pI variants N208D/Q295E/N384D/Q418E/N421D, the ablation variants E233P/L234V/L235A/G236del/S267K, and a second scFv that binds either CD3 or CLDN6. In some embodiments, the dual scFv format includes skew variants, pI variants, ablation variants and FcRn variants. In some embodiments, the dual scFv format includes skew variants, pI variants, and ablation variants. Accordingly, some embodiments include dual scFv formats that comprise: a) a first monomer that comprises the skew variants S364K/E357Q, the ablation variants E233P/L234V/L235A/G236del/S267K, the FcRn variants M428L/N434S and a first scFv that binds either CD3 or CLDN6; and b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a second scFv that binds either CD3 or CLDN6.

10. Non-Heterodimeric Bispecific Antibodies

Figure 36J:
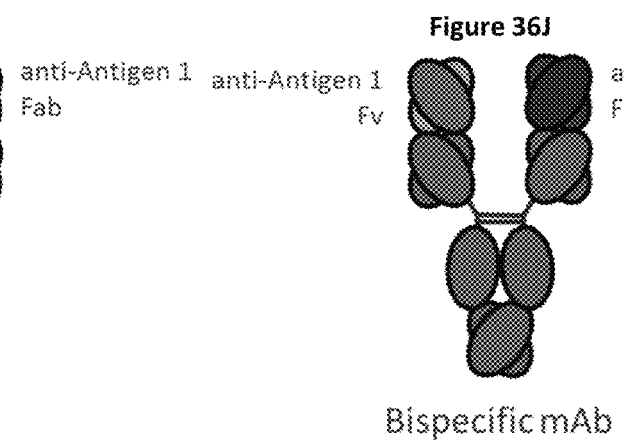

As will be appreciated by those in the art, the anti-CLDN6×anti-CD3 antibodies provided herein can also be included in non-heterodimeric bispecific formats (see FIG. 36J). In this format, the anti-CLDN6×anti-CD3 includes: 1) a first monomer comprising a VH1-CH1-hinge-CH2-CH3; 2) a second monomer comprising a VH2-CH1-hinge-CH2-CH3; 3) a first light chain comprising a VL1-CL; and 4) a second light chain comprising a VL2-CL. In such embodiments, the VH1 and VL1 form a first antigen binding domain and VH2 and VL2 form a second antigen binding domain. One of the first or second antigen binding domains binds CLDN6 and the other antigen binding domain binds CD3.

Any suitable CLDN6 binding domain and CD3 binding domain can be included in the anti-CLDN6×anti-CD3 antibody in the non-heterodimeric bispecific antibody format, including any of the CLDN6 binding domains and CD3 binding domains and related VHs and VLs provided herein or a variant thereof (see, e.g., FIGS. 10, 13-15 and 18).

11. Trident Format

In some embodiments, the bispecific antibodies described herein are in the "Trident" format as generally described in WO2015/184203, hereby expressly incorporated by reference in its entirety and in particular for the Figures, Legends, definitions and sequences of "Heterodimer-Promoting Domains" or "HPDs", including "K-coil" and "E-coil" sequences. Tridents rely on using two different HPDs that associate to form a heterodimeric structure as a component of the structure. In this embodiment, the Trident format include a "traditional" heavy and light chain (e.g., VH1-CH1-hinge-CH2-CH3 and VL1-CL), a third chain comprising a first "diabody-type binding domain" or "DART®", VH2-(linker)-VL3-HPD1 and a fourth chain comprising a second DART®, VH3-(linker)-(linker)-VL2-HPD2. The VH1 and VL1 form a first ABD, the VH2 and VL2 form a second ABD, and the VH3 and VL3 form a third ABD. In some cases, the second and third ABDs bind the same antigen, in this instance generally CLDN6, e.g., bivalently, with the first ABD binding a CD3 monovalently.

Any suitable CLDN6 binding domain and CD3 binding domain can be included in the anti-CLDN6×anti-CD3 antibody in the Trident bispecific antibody format, including any of the CLDN6 binding domains and CD3 binding domains and related VHs and VLs provided herein or a variant thereof (see, e.g., FIGS. 10, 13-15 and 18).

12. Monospecific, Monoclonal Antibodies

As will be appreciated by those in the art, the novel CLDN6 ABD sequences outlined herein can also be used in both monospecific antibodies (e.g., "traditional monoclonal antibodies") or non-heterodimeric bispecific formats. Accordingly, in some embodiments, the antibodies described herein provide monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H_L" designation can be linked to the constant region of a human IgG1 antibody.

Any suitable CLDN6 ABD can be included in the monospecific antibody, including any of the CLDN6 ABDs described herein. In some embodiments, the monospecific antibody is an CLDN6 monospecific antibody that has a VH_VL pairs selected from the group consisting of: H1_L1, H1.1_L1, H1.2_L1, H1.3_L1, H1.4_L1, H1.5_L1, H1.6_L1, H1.7_L1, H1.8_L1, H1.9_L1, H1.19_L1, H1.22_L1, H1.24_L1, H2_L1, H2.1_L1, H2.2_L1, H2.3_L1, H2.4_L1, H2.5_L1, H2.6_L1, H2.7_L1, H2.8_L1, H2.9_L1, H2.11_L1, H2.12_L1, H2.71_L1, H2.75_L1, H2.90_L1, H2.91_L1, H2.118_L1, H2.119_L1, H1_L1.1, H1.1_L1.1, H1.2_L1.1, H1.3_L1.1, H1.4_L1.1, H1.5_L1.1, H1.6_L1.1, H1.7_L1.1, H1.8_L1.1, H1.9_L1.1, H1.19_L1.1, H1.22_L1.1, H1.24_L1.1, H2_L1.1, H2.1_L1.1, H2.2_L1.1, H2.3_L1.1, H2.4_L1.1, H2.5_L1.1, H2.6_L1.1, H2.7_L1.1, H2.8_L1.1, H2.9_L1.1, H2.11_L1.1, H2.12_L1.1, H2.71_L1.1, H2.75_L1.1, H2.90_L1.1, H2.91_L1.1, H2.118_L1.1, H2.119_L1.1, H1_L1.4, H1.1_L1.4, H1.2_L1.4, H1.3_L1.4, H1.4_L1.4, H1.5_L1.4, H1.6_L1.4, H1.7_L1.4, H1.8_L1.4, H1.9_L1.4, H1.19_L1.4, H1.22_L1.4, H1.24_L1.4, H2_L1.4, H2.1_L1.4, H2.2_L1.4, H2.3_L1.4, H2.4_L1.4, H2.5_L1.4, H2.6_L1.4, H2.7_L1.4, H2.8_L1.4, H2.9, L1.4_H2.11_L1.4, H2.12_L1.4, H2.71_L1.4, H2.75_L1.4, H2.90_L1.4, H2.91_L1.4, H2.118_L1.4, H2.119_L1.4, H1_L1.7, H1.1_L1.7, H1.2_L1.7, H1.3_L1.7, H1.4_L1.7, H1.5_L1.7, H1.6_L1.7, H1.7_L1.7, H1.8_L1.7, H1.9_L1.7, H1.19_L1.7, H1.22_L1.7, H1.24_L1.7, H2_L1.7, H2.1_L1.7, H2.2_L1.7, H2.3_L1.7, H2.4_L1.7, H2.5_L1.7, H2.6_L1.7, H2.7_L1.7, H2.8_L1.7, H2.9_L1.7, H2.11_L1.7, H2.12_L1.7, H2.71_L1.7, H2.75_L1.7, H2.90_L1.7, H2.91_L1.7, H2.118_L1.7, H2.119_L1.7, H1_L1.16, H1.1_L1.16, H1.2_L1.16, H1.3_L1.16, H1.4_L1.16, H1.5_L1.16, H1.6_L1.16, H1.7_L1.16, H1.8_L1.16, H1.9_L1.16, H1.19_L1.16, H1.22_L1.16, H1.24_L1.16, H2_L1.16, H2.1_L1.16, H2.2_L1.16, H2.3_L1.16, H2.4_L1.16, H2.5_L1.16, H2.6_L1.16, H2.7_L1.16, H2.8_L1.16, H2.9_L1.16, H2.11_L1.16, H2.12_L1.16, H2.71_L1.16, H2.75_L1.16, H2.90_L1.16, H2.91_L1.16, H2.118_L1.16, H2.119_L1.16, H1_L1.18, H1.1_L1.18, H1.2_L1.18, H1.3_L1.18, H1.4_L1.18, H1.5_L1.18, H1.6_L1.18, H1.7_L1.18, H1.8_L1.18, H1.9_L1.18, H1.19_L1.18, H1.22_L1.18, H1.24_L1.18, H2_L1.18, H2.1_L1.18, H2.2_L1.18, H2.3_L1.18, H2.4_L1.18, H2.5_L1.18, H2.6_L1.18, H2.7_L1.18, H2.8_L1.18, H2.9_L1.18, H2.11_L1.18, H2.12_L1.18, H2.71_L1.18, H2.75_L1.18, H2.90_L1.18, H2.91_L1.18, H2.118_L1.18, H2.119_L1.18, H1_L1.19, H1.1_L1.19, H1.2_L1.19, H1.3_L1.19, H1.4_L1.19, H1.5_L1.19, H1.6_L1.19, H1.7_L1.19, H1.8_L1.19, H1.9_L1.19, H1.19_L1.19, H1.22_L1.19, H1.24_L1.19, H2_L1.19, H2.1_L1.19, H2.2_L1.19, H2.3_L1.19, H2.4_L1.19, H2.5_L1.19, H2.6_L1.19, H2.7_L1.19, H2.8_L1.19, H2.9_L1.19, H2.11_L1.19, H2.12_L1.19, H2.71_L1.19, H2.75_L1.19, H2.90_L1.19, H2.91_L1.19, H2.118_L1.19, H2.119_L1.19, H1_L1.21, H1.1_L1.21, H1.2_L1.21, H1.3_L1.21, H1.4_L1.21, H1.5_L1.21, H1.6_L1.21, H1.7_L1.21, H1.8_L1.21, H1.9_L1.21, H1.19_L1.21, H1.22_L1.21, H1.24_L1.21, H2_L1.21, H2.1_L1.21, H2.2_L1.21, H2.3_L1.21, H2.4_L1.21, H2.5_L1.21, H2.6_L1.21, H2.7_L1.21, H2.8_L1.21, H2.9_L1.21, H2.11_L1.21, H2.12_L1.21, H2.71_L1.21, H2.75_L1.21, H2.90_L1.21, H2.91_L1.21, H2.118_L1.2, H2.119_L1.21, H1_L1.22, H1.1_L1.22, H1.2_L1.22, H1.3_L1.22, H1.4_L1.22, H1.5_L1.22, H1.6_L1.22, H1.7_L1.22, H1.8_L1.22, H1.9_L1.22, H1.19_L1.22, H1.22_L1.22, H1.24_L1.22, H2_L1.22, H2.1_L1.22, H2.2_L1.22, H2.3_L1.22, H2.4_L1.22, H2.5_L1.22, H2.6_L1.22, H2.7_L1.22, H2.8_L1.22, H2.9_L1.22, H2.11_L1.22, H2.12_L1.22, H2.71_L1.22, H2.75_L1.22, H2.90_L1.22, H2.91_L1.22, H2.118_L1.22, H2.119_L1.22, H1_L1.23, H1.1_L1.23, H1.2_L1.23, H1.3_L1.23, H1.4_L1.23, H1.5_L1.23, H1.6_L1.23, H1.7_L1.23, H1.8_L1.23, H1.9_L1.23, H1.19_L1.23, H1.22_L1.23, H1.24_L1.23, H2_L1.23, H2.1_L1.23, H2.2_L1.23, H2.3_L1.23, H2.4_L1.23, H2.5_L1.23, H2.6_L1.23, H2.7_L1.23, H2.8_L1.23, H2.9_L1.23, H2.11_L1.23, H2.12_L1.23, H2.71_L1.23, H2.75_L1.23, H2.90_L1.23, H2.91_L1.23, H2.118_L1.23, H2.119_L1.23, H1_L1.27, H1.1_L1.27, H1.2_L1.27, H1.3_L1.27, H1.4_L1.27, H1.5_L1.27, H1.6_L1.27, H1.7_L1.27, H1.8_L1.27, H1.9_L1.27, H1.19_L1.27, H1.22_L1.27, H1.24_L1.27, H2_L1.27, H2.1_L1.27, H2.2_L1.27, H2.3_L1.27, H2.4_L1.27, H2.5_L1.27, H2.6_L1.27, H2.7_L1.27, H2.8_L1.27, H2.9_L1.27, H2.11_L1.27, H2.12_L1.27, H2.71_L1.27, H2.75_L1.27, H2.90_L1.27, H2.91_L1.27, H2.118_L1.27, H2.119_L1.27, H1_L1.60, H1.1_L1.60, H1.2_L1.60, H1.3_L1.60, H1.4_L1.60, H1.5_L1.60, H1.6_L1.60, H1.7_L1.60, H1.8_L1.60, H1.9_L1.60, H1.19_L1.60, H1.22_L1.60, H1.24_L1.60, H2_L1.60, H2.1_L1.60, H2.2_L1.60, H2.3_L1.60, H2.4_L1.60, H2.5_L1.60, H2.6_L1.60, H2.7_L1.60, H2.8_L1.60, H2.9_L1.60, H2.11_L1.60, H2.12_L1.60, H2.71_L1.60, H2.75_L1.60, H2.90_L1.60, H2.91_L1.60, H2.118_L1.60, H2.119_L1.60, H1_L1.107, H1.1_L1.107, H1.2_L1.107, H1.3_L1.107, H1.4_L1.107, H1.5_L1.107, H1.6_L1.107, H1.7_L1.107, H1.8_L1.107, H1.9_L1.107, H1.19_L1.107, H1.22_L1.107, H1.24_L1.107, H2_L1.107, H2.1_L1.107, H2.2_L1.107, H2.3_L1.107, H2.4_L1.107, H2.5_L1.107, H2.6_L1.107, H2.7_L1.107, H2.8_L1.107, H2.9_L1.107, H2.11_L1.107, H2.12_L1.107, H2.71_L1.107, H2.75_L1.107, H2.90_L1.107, H2.91_L1.107, H2.118_L1.107, H2.119_L1.107, H1_L1.114, H1.1_L1.114, H1.2_L1.114, H1.3_L1.114, H1.4_L1.114, H1.5_L1.114, H1.6_L1.114, H1.7_L1.114, H1.8_L1.114, H1.9_L1.114, H1.19_L1.114, H1.22_L1.114, H1.24_L1.114, H2_L1.114, H2.1_L1.114, H2.2_L1.114, H2.3_L1.114, H2.4_L1.114, H2.5_L1.114, H2.6_L1.114, H2.7_L1.114, H2.8_L1.114, H2.9_L1.114, H2.11_L1.114, H2.12_L1.114, H2.71_L1.114, H2.75_L1.114, H2.90_L1.114, H2.91_L1.114, H2.118_L1.114, H2.119_L1.114, H1_L1.187, H1.1_L1.187, H1.2_L1.187, H1.3_L1.187, H1.4_L1.187, H1.5_L1.187, H1.6_L1.187, H1.7_L1.187, H1.8_L1.187, H1.9_L1.187, H1.19_L1.187, H1.22_L1.187, H1.24_L1.187, H2_L1.187, H2.1_L1.187, H2.2_L1.187, H2.3_L1.187, H2.4_L1.187, H2.5_L1.187, H2.6_L1.187, H2.7_L1.187, H2.8_L1.187, H2.9_L1.187, H2.11_L1.187, H2.12_L1.187, H2.71_L1.187, H2.75_L1.187, H2.90_L1.187, H2.91_L1.187, H2.118_L1.187, H2.119_L1.187, H1_L1.189, H1.1_L1.189, H1.2_L1.189, H1.3_L1.189, H1.4_L1.189, H1.5_L1.189, H1.6_L1.189, H1.7_L1.189, H1.8_L1.189, H1.9_L1.189, H1.19_L1.189, H1.22_L1.189, H1.24_L1.189, H2_L1.189, H2.1_L1.189, H2.2_L1.189, H2.3_L1.189, H2.4_L1.189, H2.5_L1.189, H2.6_L1.189, H2.7_L1.189, H2.8_L1.189, H2.9_L1.189, H2.11_L1.189, H2.12_L1.189, H2.71_L1.189, H2.75_L1.189, H2.90_L1.189, H2.91_L1.189, H2.118_L1.189, H2.119_L1.189, H1_L2, H1.1_L2, H1.2_L2, H1.3_L2, H1.4_L2, H1.5_L2, H1.6_L2, H1.7_L2, H1.8_L2, H1.9_L2, H1.19_L2, H1.22_L2, H1.24_L2, H2_L2, H2.1_L2, H2.2_L2, H2.3_L2, H2.4_L2, H2.5_L2, H2.6_L2, H2.7_L2, H2.8_L2, H2.9_L2, H2.11_L2, H2.12_L2, H2.71_L2, H2.75_L2, H2.90_L2, H2.91_L2, H2.118_L2 and H2.119_L2 or a variant thereof.

In particular monoclonal embodiments, the VH_VL pair is selected from the group consisting of H1.9_L1.187, H1.24_L1.187, H2.91_L1.187 and H1.9_L1.187 or a variant thereof.

E. Particular Embodiments of the Invention

The invention specifically provides 1+1 and 2+1 formats that bind CD3 and CLDN6.

1. 1+1 Format

In particular 1+1 format embodiments, the αCLDN6 ABD is the Fab and has the VH_VL pair H1.9_L1.187 and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

In particular 1+1 format embodiments, the αCLDN6 ABD is the Fab and has the VH_VL pair H1.24_L1.187, and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti- CD3_L1.47_H1.32, anti-CD3_L1.47_H1.89, anti-CD3_L1.47_H1.90, anti-CD3_L1.47_H1.33, and anti-CD3_L1.47_H1.31.

In particular 1+1 format embodiments, the αCLDN6 ABD is the Fab and has the VH_VL pair H2.91_L1.187 and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

In particular 1+1 format embodiments, the αCLDN6 ABD is the Fab and has the VH_VL pair H1.9_L1.187. and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

2. 2+1 Format

In particular 2+1 format embodiments, the αCLDN6 ABD is the Fab and has the VH_VL pair H1.9_L1.187 and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

In particular 2+1 format embodiments, the αCLDN6 ABD is the Fab and has the VH_VL pair H1.24_L1.187, and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

In particular 2+1 format embodiments, the αCLDN6 ABD is the Fab and has the VH_VL pair H2.91_L1.187 and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

In particular 2+1 format embodiments, the αCLDN6 ABD is the Fab and has the VH_VL pair H1.9_L1.187. and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

V. Nucleic Acids of the Invention

The disclosure further provides nucleic acid compositions encoding the anti-CLDN6 antibodies provided herein, including, but not limited to, anti-CLDN6×anti-CD3 bispecific antibodies and CLDN6 monospecific antibodies.

As will be appreciated by those in the art, the nucleic acid compositions will depend on the format and scaffold of the heterodimeric protein. Thus, for example, when the format requires three amino acid sequences, such as for the 1+1 Fab-scFv-Fc format (e.g. a first amino acid monomer comprising an Fc domain and a scFv, a second amino acid monomer comprising a heavy chain and a light chain), three nucleic acid sequences can be incorporated into one or more expression vectors for expression. Similarly, some formats (e.g. dual scFv formats such as disclosed in FIG. 1) only two nucleic acids are needed; again, they can be put into one or two expression vectors.

As is known in the art, the nucleic acids encoding the components of the antibodies described herein can be incorporated into expression vectors as is known in the art, and depending on the host cells used to produce the heterodimeric antibodies described herein. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the antibodies described herein are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer and the optional nucleic acid encoding a light chain, as applicable depending on the format, are each contained within a single expression vector, generally under different or the same promoter controls. In embodiments of particular use in the antibodies described herein, each of these two or three nucleic acids are contained on a different expression vector. As shown herein and in 62/025,931, hereby incorporated by reference, different vector ratios can be used to drive heterodimer formation. That is, surprisingly, while the proteins comprise first monomer:second monomer:light chains (in the case of many of the embodiments herein that have three polypeptides comprising the heterodimeric antibody) in a 1:1:2 ratio, these are not the ratios that give the best results.

The heterodimeric antibodies described herein are made by culturing host cells comprising the expression vector(s) as is well known in the art. Once produced, traditional antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "1+1 Fab-scFv-Fc" and "2+1" heterodimers (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

VI. Biological and Biochemical Functionality of the Heterodimeric Bispecific Antibodies Generally the bispecific CLDN6×CD3 antibodies described herein are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays.

VII. Treatments

Once made, the compositions of the antibodies described herein find use in a number of applications. CLDN6 is highly expressed in renal cell carcinoma, accordingly, the heterodimeric compositions of the antibodies described herein find use in the treatment of such CLDN6 positive cancers.

VIII. Antibody Compositions for In Vivo Administration

Formulations of the antibodies used in accordance with the antibodies described herein are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions.

IX. Administrative Modalities

The antibodies and chemotherapeutic agents described herein are administered to a subject, in accord with known methods, such as intravenous administration as a bolus or by continuous infusion over a period of time.

X. Treatment Modalities

In the methods described herein, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MM) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the disclosure includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the disclosure are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies described herein depend on the disease or condition to be treated and may be determined by the persons skilled in the art.

An exemplary, non-limiting range for a therapeutically effective amount of an bispecific antibody used in the antibodies described herein is about 0.1-100 mg/kg.

All cited references are herein expressly incorporated by reference in their entirety.

Whereas particular embodiments of the disclosure have been described above for purposes of illustration, it will be appreciated by those skilled in the art that numerous variations of the details may be made without departing from the invention as described in the appended claims.

EXAMPLES

A. Example 1: Engineering αCLDN6×αCD3 Bispecific Antibodies

Sequences for CD3 binding domains having different CD3 binding affinities are depicted in FIG. 10. Sequences for CLDN6 binding domains are depicted in FIGS. 14-15. A number of formats for αCLDN6×αCD3 bispecific antibodies (bsAbs) were conceived, illustrative formats for which are outlined below and in FIG. 17.

One such format is the 1+1 Fab-scFv-Fc format which comprises a single-chain Fv ("scFv") covalently attached to a first heterodimeric Fc domain, a heavy chain variable region (VH) covalently attached to a complementary second heterodimeric Fc domain, and a light chain (LC) transfected separately so that a Fab domain is formed with the variable heavy domain.

Another format is the 2+1 Fab2-scFv-Fc format which comprises a VH domain covalently attached to a CH1 domain covalently attached to an scFv covalently attached to a first heterodimeric Fc domain (VH-CH1-scFv-Fc), a VH domain covalently attached to a complementary second heterodimeric Fc domain, and a LC transfected separately so that Fab domains are formed with the VH domains.

DNA encoding chains of the αCLDN6×αCD3 bsAbs were generated by standard gene synthesis followed by isothermal cloning (Gibson assembly) or subcloning into a pTT5 expression vector containing fusion partners (e.g. domain linkers as depicted in FIG. 6 and/or backbones as depicted in FIGS. 7-9). DNA was transfected into HEK293E cells for expression. Sequences for illustrative αCLDN6× αCD3 bsAbs (based on binding domains as described above) in the 1+1 Fab-scFv-Fc format and in the 2+1 Fab2-scFv-Fc format are depicted respectively in FIGS. 19-22.

B. Example 2: Engineering CLDN6 Binding Domains for Enhanced Selectivity

The claudin family of proteins include numerous other claudins. Jukes-Cantor distance of various claudin sequences to CLDN6 were determined as follows: CLDN9 (0.32), CLDN4 (0.51), CLDN3 (0.52), CLDN5 (0.64), CLDN8 (0.8), and CLDN17 (0.82). In comparison to CLDN6, CLDN9 is more highly expressed in healthy tissues (e.g. the cervix and the esophagus), so cross-reactivity of CLDN6 therapeutic with CLDN9 could lead to off-target toxicity. However in addition to having Jukes-Cantor Distance off just 0.32 and 96% identity, CLDN6 and CLDN9 differ by only 3 residues in their extracellular loops (as depicted in FIG. 12); therefore, it is a significant challenge to develop an antibody capable of binding CLDN6 selectively over CLDN9. Accordingly, this section describes identification and engineering of suitable CLDN6 binding domains (with minimal cross-reactivity) suitable for use in the αCLDN6×αCD3 bsAbs of the invention. Additionally, a prior art CLDN6 binding domain described in U.S. Pat. No. 10,233,253 was used as a comparator (in a bivalent mAb format as in XENP26863 and in a 1+1 Fab-scFv-Fc bsAb with CD3 High scFv as in XENP26849; sequences depicted in FIG. 18.

The following experiments used to screen CLDN6 binding domains were generally performed as follows. HEK293T or HEK293E cells were respectively stably or transiently transfected to express CLDN6, CLND9, or other targets of interest. 48 hours post transfection, cells were harvested and incubated with dilutions of the indicated test articles for 1 hour at 4° C. Next, cells were washed and stained with a secondary antibody (typically anti-human Fc AlexaFluor647) for 1 hour at 4° C., followed by two more washes. Binding was then assessed via flow cytometry.

1. Identification of CLDN6 Binding Domains Selective for CLDN6 Over CLDN9

Six murine anti-CLDN6 mAbs were investigated for their binding to CLDN6 and CLDN9, as well to CLDN3 and CLDN4 which are also members of the claudin family. FIG. 23 depicts binding of the mAbs to transfected cells. Specificity for targets was determined by comparing EC50 values and AUC (area under the binding curve). The data show that clones C6-10, C6-15, and C6-21 were not selective for CLDN6 over CLDN9. Additionally, clone C6-10 even showed some binding to CLDN4. Notably, clones C6-11, C6-24, and C6-30 demonstrated selectivity for CLDN6 over CLDN9 and little to no binding to CLDN3 and CLDN4.

2. Humanization of CLDN6 Binding Domains

Figure 26E:
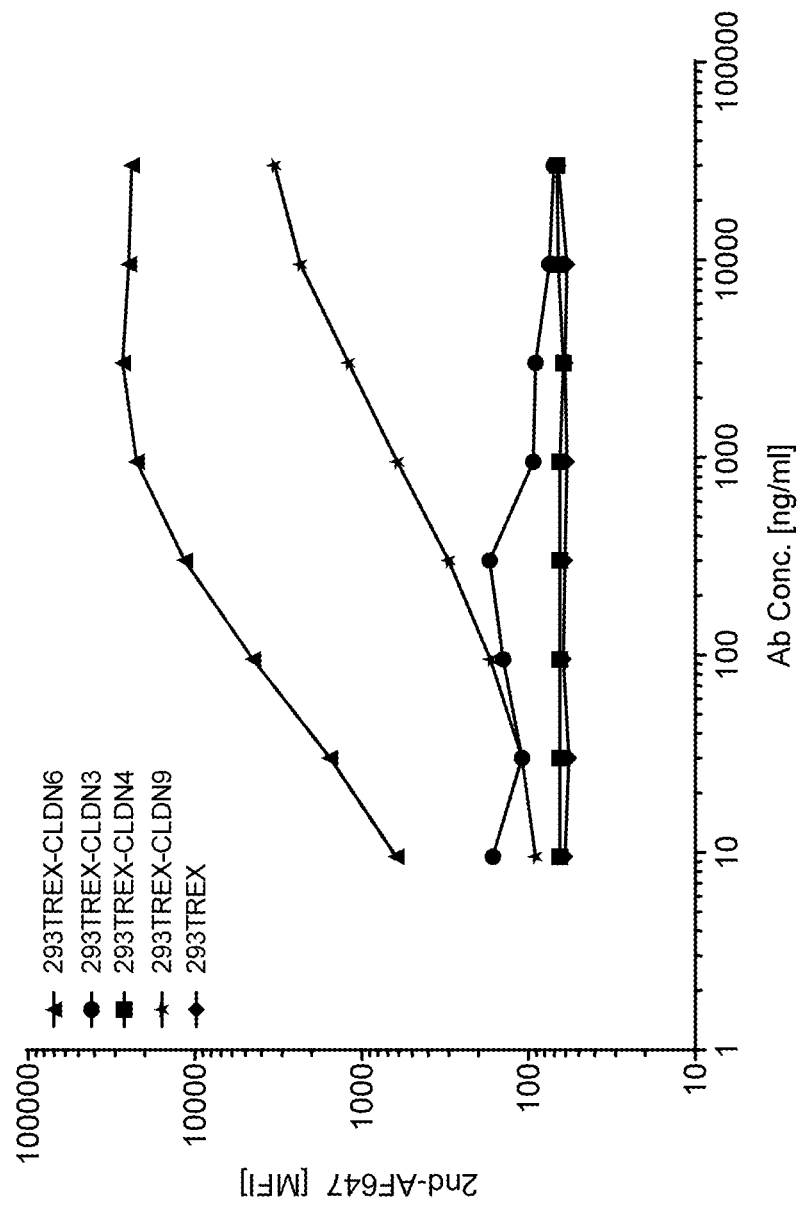
Figure 28A:
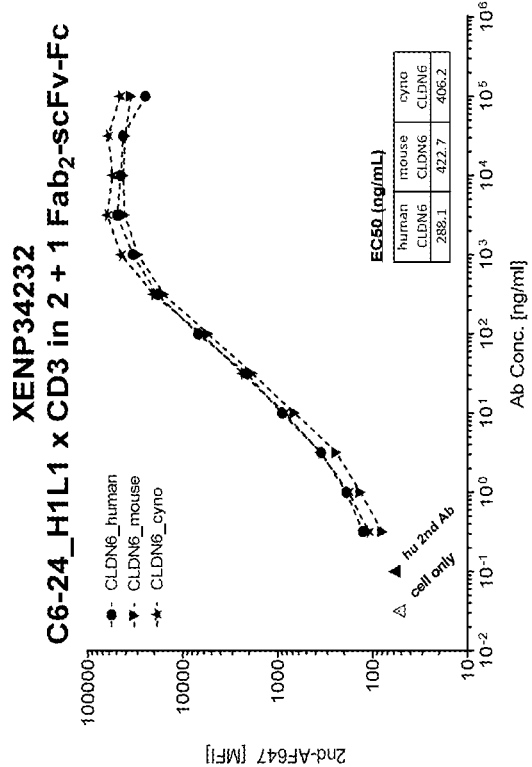
FIGS. 28A-28F depicts binding of A) XENP34228 (C6-24_H1L1×CD3 bsAb in the 1+1 Fab-scFv-Fc format), B) XENP34232 (C6-24_H1L1×CD3 bsAb in the 2+1 Fab₂-scFv-Fc format), C) XENP34229 (C6-30_H1L1×CD3 bsAb in the 1+1 Fab-scFv-Fc format), D) XENP34233 (C6-30_H1L1×CD3 bsAb in the 2+1 Fab₂-scFv-Fc format), E) XENP34637 (C6-30_H2L1×CD3 bsAb in the 1+1 Fab-scFv-Fc format), and F) XENP34638 (C6-30_H2L1×CD3 bsAb in the 2+1 Fab₂-scFv-Fc format) to HEK293E cells expressing human, cynomolgus, and mouse CLDN6. Each of the variants were cross-reactive for human, cynomolgus, and mouse CLDN6 irrespective of bispecific format.
Figure 28B:
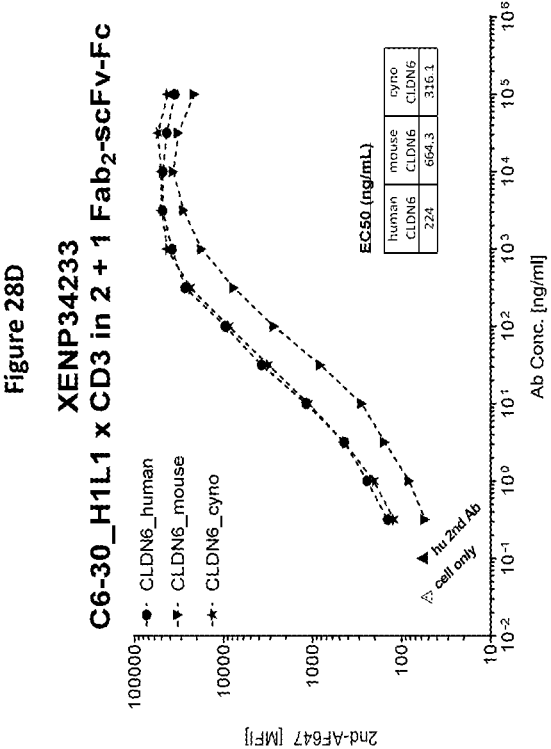
Figure 28C:
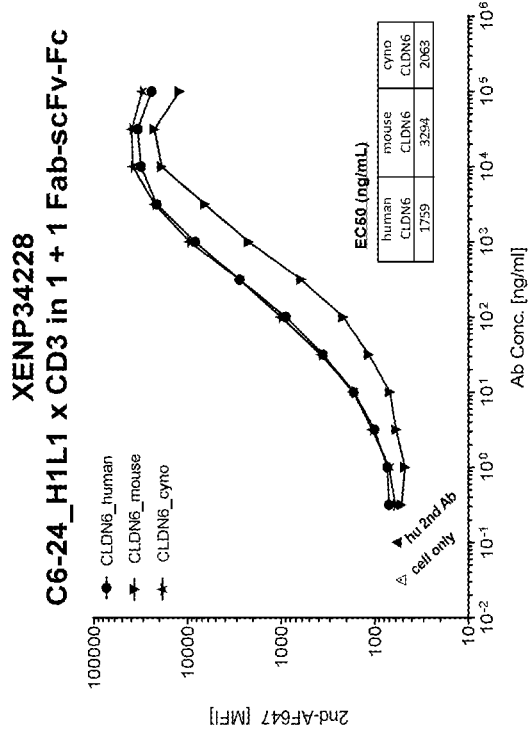
Figure 28D:
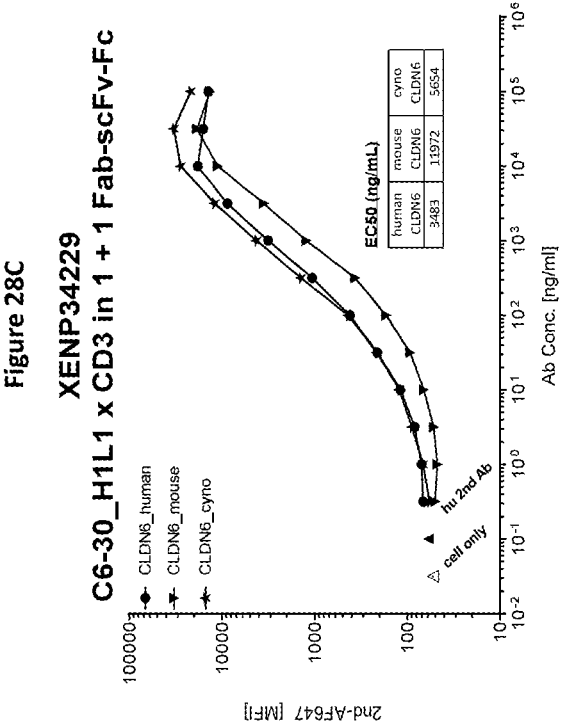
Figure 28E:
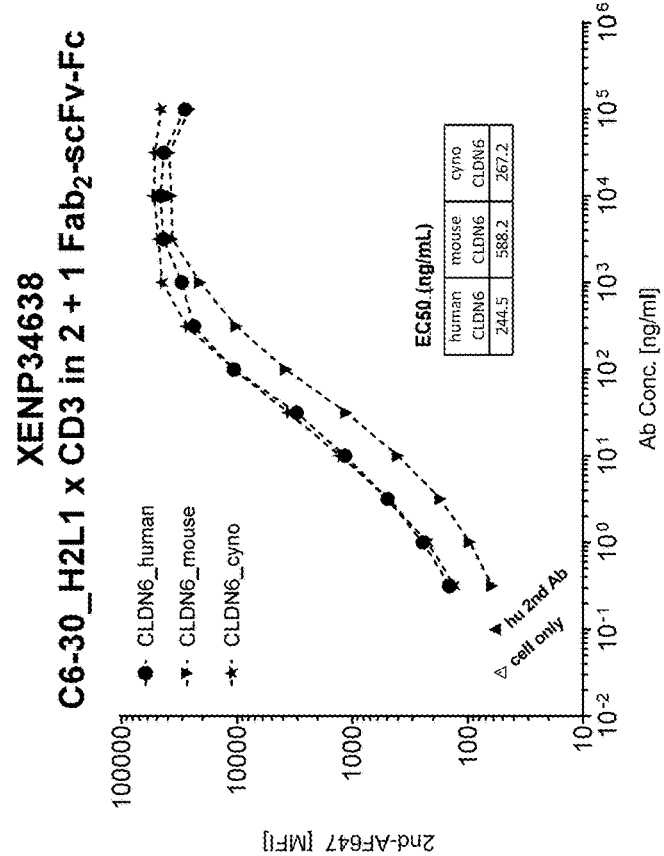
Figure 28F:
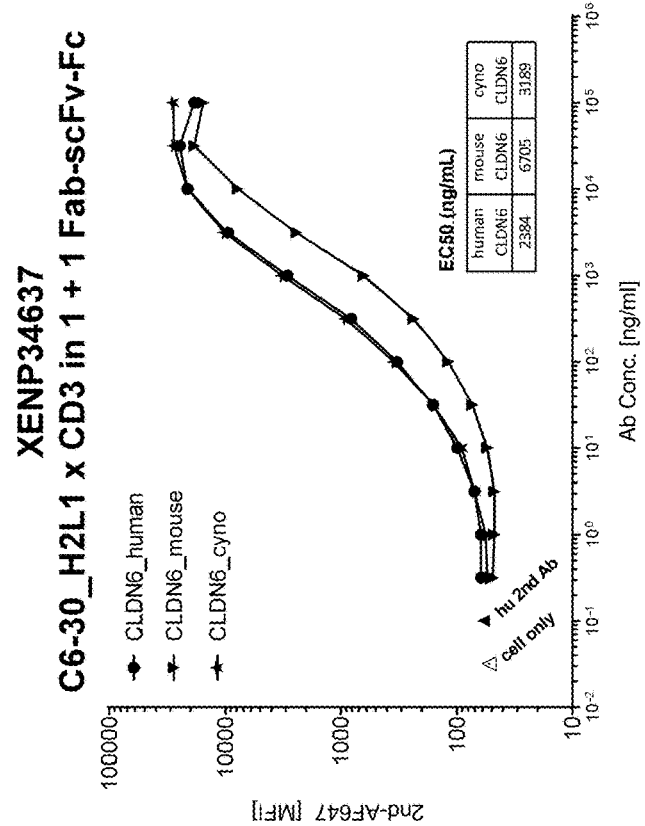
Figure 29A:
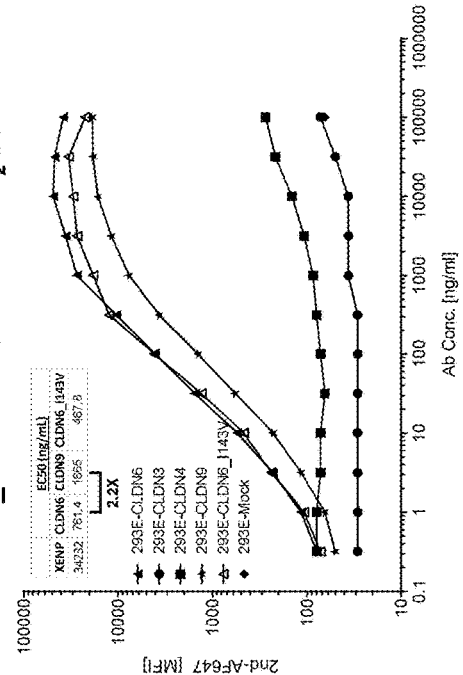
FIGS. 29A-29F depicts binding of A) XENP34228 (C6-24_H1L1×CD3 bsAb in the 1+1 Fab-scFv-Fc format), B) XENP34232 (C6-24_H1L1×CD3 bsAb in the 2+1 Fab2-scFv-Fc format), C) XENP34229 (C6-30_H1L1×CD3 bsAb in the 1+1 Fab-scFv-Fc format), D) XENP34233 (C6-30_H1L1×CD3 bsAb in the 2+1 Fab2-scFv-Fc format), E) XENP34637 (C6-30_H2L1×CD3 bsAb in the 1+1 Fab-scFv-Fc format), and F) XENP34638 (C6-30_H2L1×CD3 bsAb in the 2+1 Fab2-scFv-Fc format) to HEK293E cells expressing CLDN6, CLDN6 I143V isotype, CLDN9, CLDN3, and CLDN4. Each of the humanized C6-30 variants demonstrated enhanced selectivity in the 2+1 Fab2-scFv-Fc format, in contrast to the humanized C6-24 variant which demonstrated similar selectivity in the 1+1 Fab-scFv-Fc format and the 2+1 Fab2-scFv-Fc format.
Figure 29B:
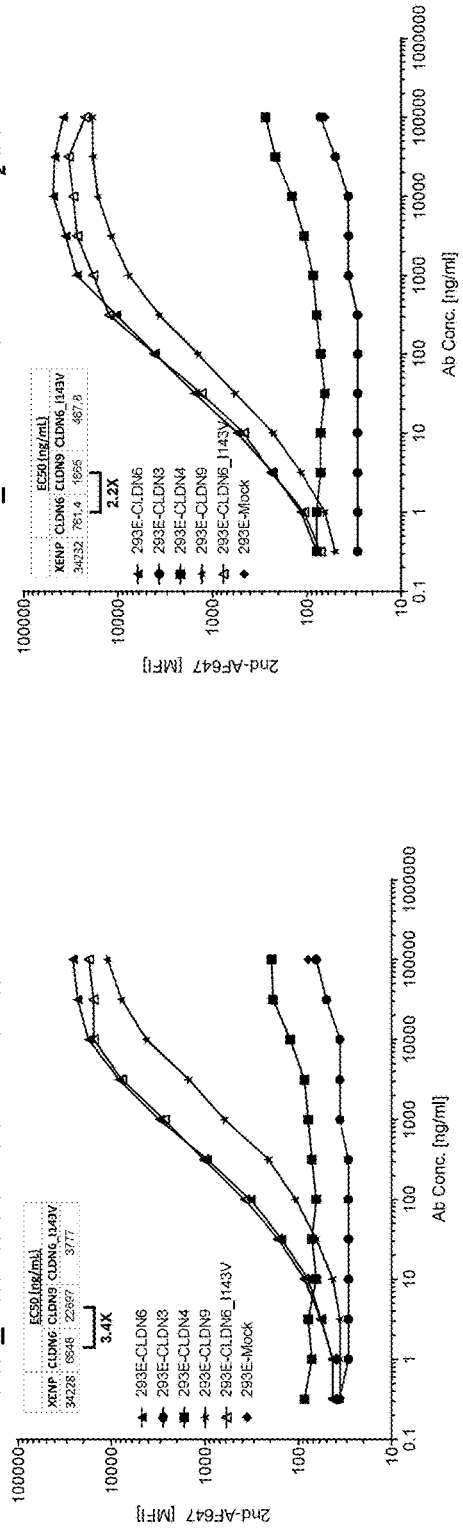
Figure 29C:
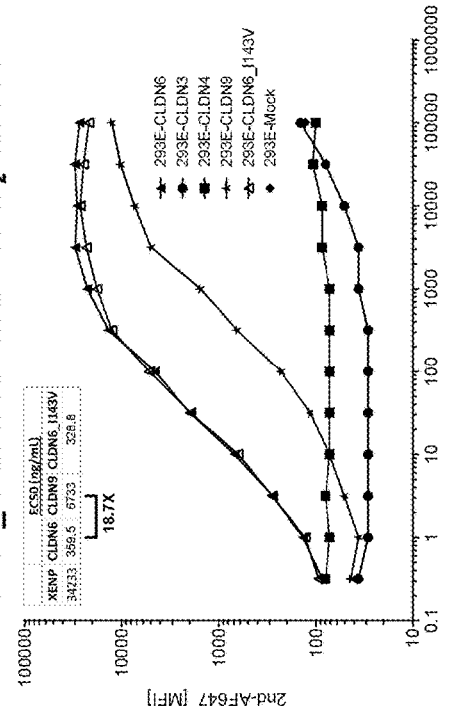
Figure 29D:
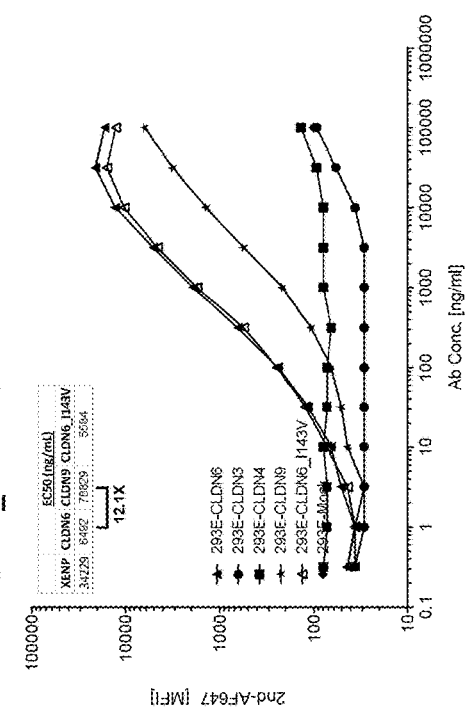
Figure 29F:
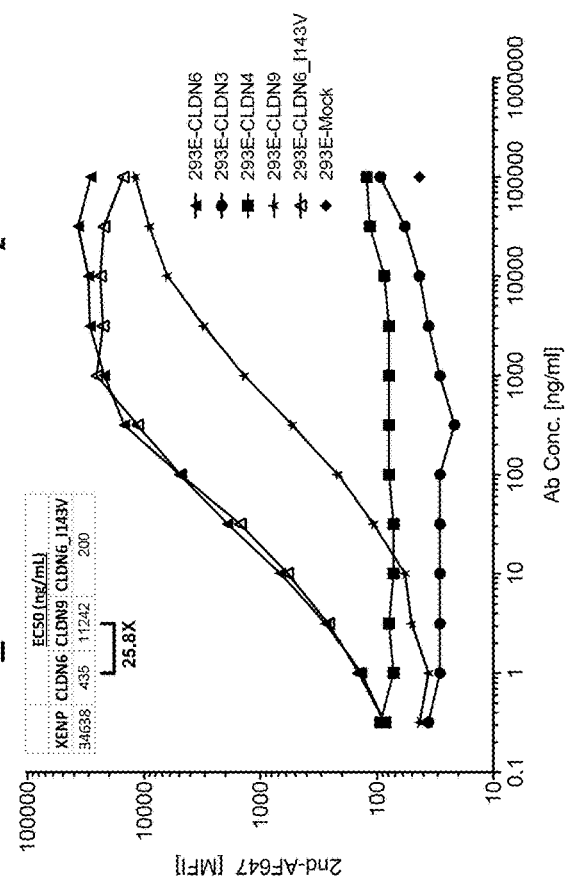
Figure 29E:
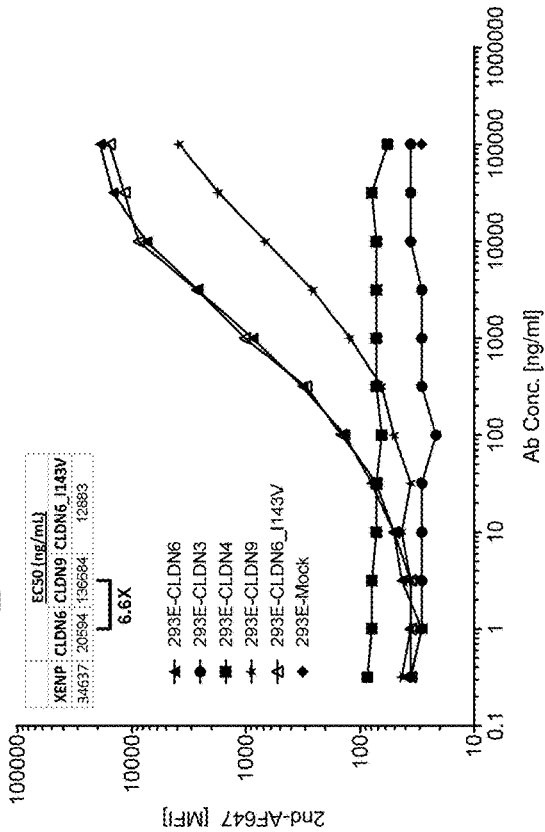

The variable regions of C6-11, C6-24, and C6-30 were humanized using string content optimization (see, e.g., U.S. Pat. No. 7,657,380, issued Feb. 2, 2010). For each clone, two humanized variable heavy domains (i.e. H1 and H2) and two humanized variable light domains (i.e. L1 and L2) were engineered and paired (i.e. H1L1, H1L2, H2L1, H2L2). Sequences for humanized C6-30 variable domains and bivalent mAbs based on the domains are depicted respectively in FIGS. 14 and 16 (as XENP34218, XENP34219, XENP34220, and XENP34221). Binding of the humanized clones to CLDN3, CLDN4, CLDN6, and CLDN9 were investigated to determine whether humanization affected their binding profiles and are depicted in FIGS. 24-26. All humanized variants of clone C6-30 and C6-24 demonstrated binding profiles equivalent to their murine precursor. Unexpectedly, all humanized variants of clone C6-11 unfavorably demonstrated increased binding to CLDN4.

3. Engineering to Remove Degradation Liable Residues

The sequence for C6-30 was investigated for degradation liable residues. Heavy chain CDR2 included D52/P52a as an isomerization motif; N54/G55 as a deamidation motif; and Q64/G75 as a deamidation motif. Accordingly, a library was made with mutations at these residues to investigate whether the liability could be removed without impacting on CLDN6 binding and selectivity. FIG. 27 depicts the variants investigated as well as their binding to CLDN6 and CLDN9 as generally described above. The data show that many of the variants that maintained selectivity had decreased binding to CLDN6. Notably, G55A did maintain selectivity with minimal loss to CLDN6 binding.

4. Characterization of CLDN6 Binding Domains for Cross-Reactivity in the Context of a Bispecific Antibody Prototype αCLDN6×αCD3 bispecific antibodies (bsAbs) in both the 1+1 Fab-scFv-Fc format and the 2+1 Fab2-scFv-Fc format were engineered and produced (as described in Example 1) using the humanized CLDN6 binding domains described above and the CD3 binding domains as described in Example 1.

For ease of clinical development (e.g. by investigating the therapeutics in model animals), it is useful for the binding domains to be cross-reactive for mouse and/or cynomolgus antigen. Therefore, the prototype αCLDN6×αCD3 bsAbs were investigated for their binding to human CLDN6, cynomolgus CLDN6, and murine CLDN6. As shown in FIG. 28, each of the prototype bsAbs were able to human, cynomolgus, and mouse CLDN6.

Next, the prototype bsAbs were investigated for their binding to confirm that formatting the CLDN6 binding domains as bispecific antibodies did not affect their selectivity for CLDN6 over CLDN9. Selectivity was determined according to CLDN9/CLDN6 EC50 ratio. As shown in FIG. 29, each of the bispecific antibodies maintained selectivity for CLDN6 over CLDN9, although the ones based on C6-30 were more selective. Notably as well, while humanized C6-24 demonstrated similar selectivity in both the 1+1

Fab-scFv-Fc format and the 2+1 Fab2-scFv-Fc format, the humanized C6-30 variants demonstrated further enhanced selectivity in the 2+1 Fab2-scFv-Fc format.

Additionally, binding to CLDN6 I143V isotype was investigated, as this variant is found in ~30% of the population, and the data show that each of the variant was able to bind the I143V isotype.

5. Engineering for Enhanced CLDN6 Selectivity

Humanized C6-30 (both H1L1 and H2L1) which already demonstrated good selectivity, especially in the context of 2+1 Fab$_2$-scFv-Fc, was engineered to enhance selectivity. In a first round of engineering, single point mutations were introduced into either the variable heavy or the variable light domain resulting in a library of ~300 variants formatted as bivalent mAbs. Each mAb was screened for binding to CLDN6 and CLDN9 (on transfected cells) at a single concentration of 30 µg/ml. Most of point mutations had a similar impact on both CLDN6 and CLDN9 (e.g. improved binding to both or reduced binding to both). Nonetheless, there were several point mutations which were found to reduce binding to CLDN9 while maintaining or even improving binding to CLDN6 (as indicated by a skew toward higher CLDN6 MFI values and lower CLDN9 MFI values; circled in FIG. 30). The binding of these variants to CLDN6 and CLDN9 were re-investigated at various concentrations in two separate experiments, data depicting EC50 and CLDN9/CLDN6 EC50 ratio for which are depicted in FIG. 31. It should be noted that binding data from the experiments cannot be compared head-to-head as antigen density on the transfected cells vary between experiments. Nonetheless, several variants were enhanced in selectivity in comparison to the parental humanized clone (i.e. XENP34218_H1L1 and XENP34220_H2L1) and in comparison to comparator XENP26863. While some of the variants such as XENP35865 having H2_L1.60 were weaker CLDN6 binders in comparison to the parental humanized clones, they were also much weaker CLDN9 binders providing drastically enhanced selectivity for CLDN6 over CLDN9. Interestingly, several variants such as XENP35101 and XENP35102 respectively having H2.8_L1 and H2.9_L1 resulted in drastically enhanced selectivity for CLDN9 over CLDN6.

Figure 32A:
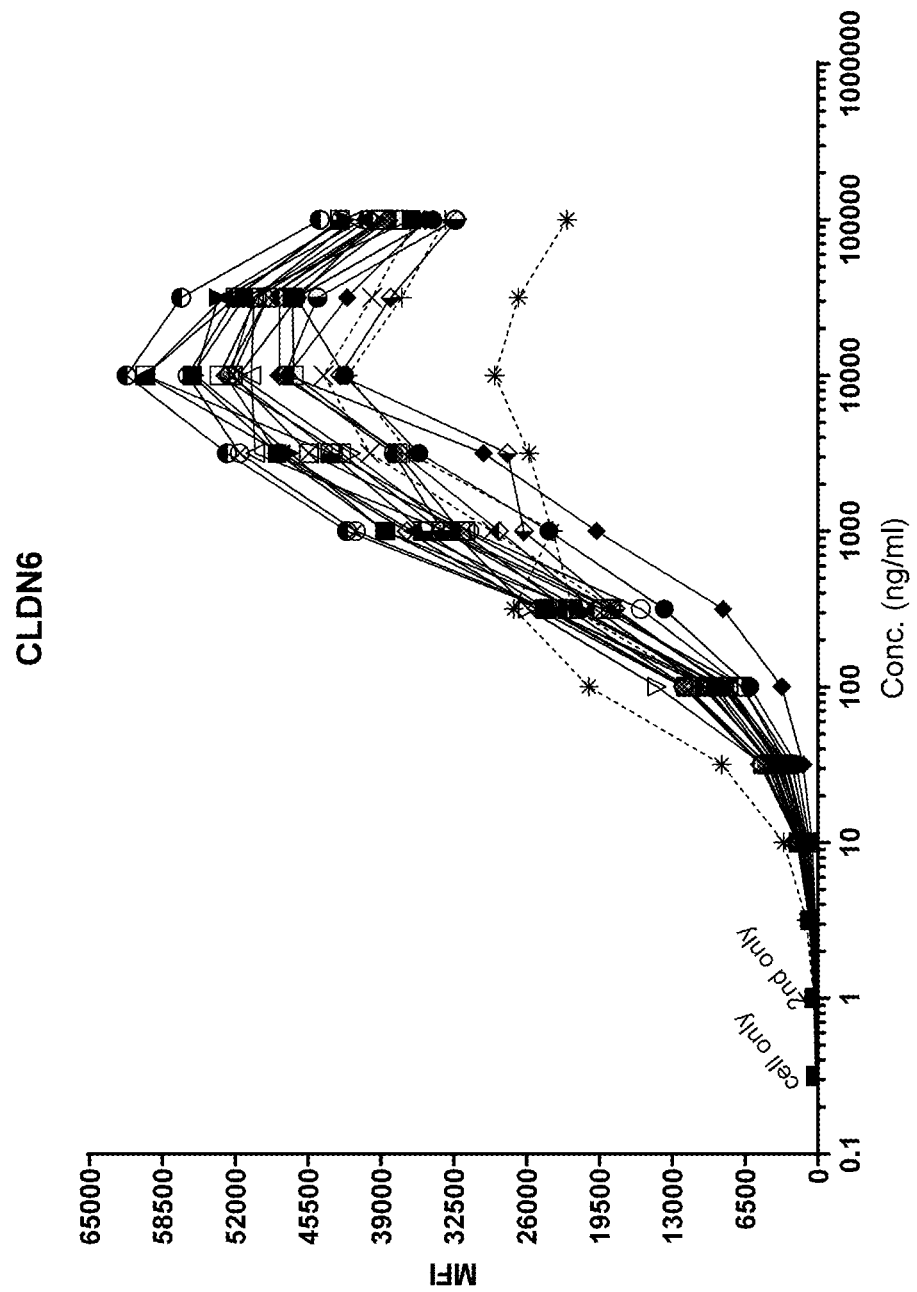
FIGS. 32A-32B depicts binding of illustrative C6-30 variants from library combining favorite variable heavy domain and variable light domain variants to HEK293E cells expressing A) CLDN6 or B) CLDN9.
Figure 32B:
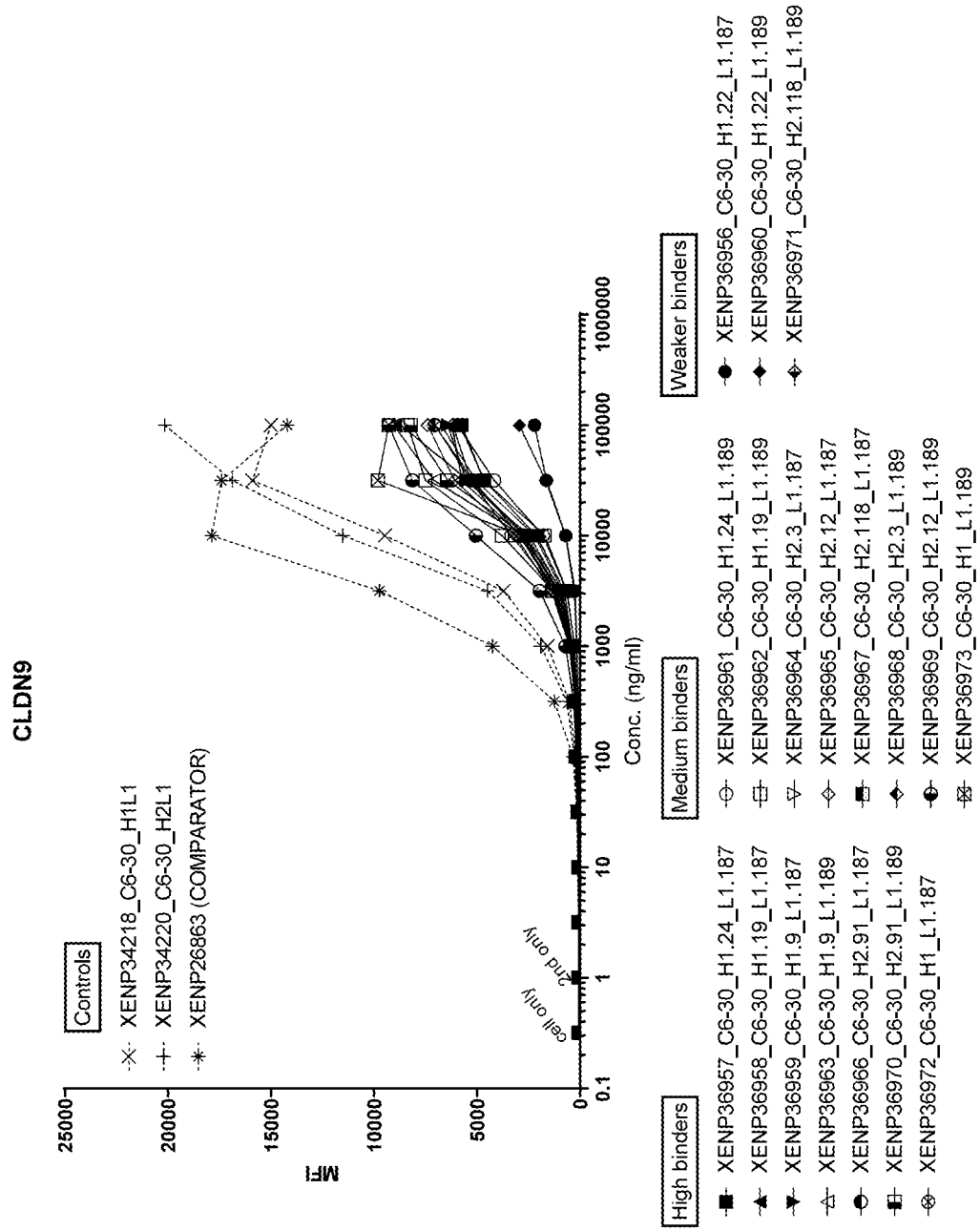

Next, favorite variant heavy domains (H1.9, H1.22, H1.24, H2.3, H2.9, H2.12, H2.90, H2.91, and H2.118) and favorite variant light domains (L1.187 and L1.189) from the first round of engineering that provided the best improvement in CLDN6 selectivity were combined to create a new library of 16 variants. The binding of these variants to CLDN6 and CLDN9 were investigated as described above, data for which are shown in FIG. 32. The data in FIG. 33 depicts the EC50 and AUC for each of the test articles as well as the CLDN9/CLDN6 EC50 ratio and CLDN6/CLDN9 AUC ratio as indicators of selectivity. Each of the 16 combination variants were enhanced in selectivity in comparison to the parental humanized clone (e.g. XENP36956 having H1.22_L1.87 and a CLDN9/CLDN6 EC50 ratio of 44.94 in comparison to XENP34218 having H1L1 and a CLDN9/CLDN6 EC50 ratio of 23.03). Notably, combining favorite variant heavy domains and favorite variant light domain did not always enhance selectivity in comparison to the parental variant (e.g. XENP36956 having H1.22_L1.187 and a CLDN9/CLDN6 EC50 ratio of 44.94 in comparison to XENP36972 having H1_L1.187 and a CLDN9/CLDN6 EC50 ratio of 52.64). Finally, 10 of the 16 combination variants demonstrated superior selectivity in comparison to comparator XENP26863 based on CLDN9/CLDN6 EC50 ratio; and 16/16 combination variants demonstrated superiority based on CLDN6/CLDN9 AUC ratio. It should be noted that variants combining variable heavy domain mutations were also investigated, but these variants did not outperform the clones with only one mutation per variable heavy domain. It should also be noted that the ratios should not be the only determinant of enhanced selectivity. For example, although XENP36956 having H1.9_L1.187 and CLDN9/CLDN6 EC50 of 44.94 appears to be slightly less selective than control XENP26863, XENP36956 had a much higher EC50 for CLDN9 binding in comparison to XENP26863 (29584 ng/ml in comparison to 2146 ng/ml) while maintaining a reasonable EC50 for CLDN6 binding.

6. Investigating Engineered CLDN6 Binding Domains in the Context of Bispecific Antibodies Finally, several of the preferred combination variants were incorporated into 2+1 Fab2-scFv-Fc CD3 bsAbs to investigate whether the bispecific format affected their selectivity. Surprisingly as depicted in FIG. 34A, many of the 2+1 Fab2-scFv-Fc bispecific antibodies including XENP37231 having C6-30_H1.24_L1.187, XENP37227 having C6-30_H1.9_L1.187, and XENP37233 having C6-30_H2.91_L1.187 demonstrated enhanced CLDN6 binding in comparison to corresponding bivalent mAb having the same variant CLDN6 binding domain; however, the C6-30_H1.22_L1.89 variant actually demonstrated decreased binding in the bispecific format in comparison to the monospecific bivalent format while several other variants demonstrated similar binding in both the bispecific format and the monospecific bivalent format. Additionally surprising as depicted in FIG. 34B, several of the 2+1 Fab2-scFv-Fc bispecific antibodies including XENP37227 comprising C6-30_H1.9_L1.187 variant and XENP37231 having C6-30_H1.24_L1.187 variant demonstrated reduced CLDN9 binding in comparison to corresponding bivalent mAb having the same variant CLDN6 binding domain.

7. Investigating Additional Off-Target Binding

To ascertain cross-reactivity to other proteins in the claudin family, binding of C6-24_H1L1, C6-30_H1L1, and C6-30_H2L1 to CLDN5, CLDN8, and CLDN17 was investigated as generally described above. Data as depicted in FIG. 35 show that none of the clones were cross-reactive for the additional claudins investigated. Additionally, C6-30 variants were screened alongside XENP37217 (a CLDN6× CD3 bispecific using a comparator CLDN6 binding domain, the sequence for which is depicted in FIG. 60) for binding to CLDN3, CLDN4, CLDN8, and CLDN17. 293 cells were transiently transfected with CLDN3, CLDN4, CLDN8, or CLDN17. Cells were plated and each test article was added to each cell line at a 100 µg/ml dose. After 1 hour incubation at 4° C., cells were washed and a secondary AF647 antibody was added. Cells were incubated at 4° C. for another hour, followed by additional washing and then analysis by flow cytometry. For each of these different claudin family members, the comparator molecule XENP37217 showed higher binding than the test articles utilizing the C6-30 binding domains. XENP37217 showed particularly strong binding for CLDN8 and CLDN17, producing an MFI more than an order of magnitude higher than the C6-30 variants, as depicted in FIG. 61. This highlights the potential of CLDN6 binding domains having specificity for binding not only CLDN6 but also other claudin family members.

C. Example 3: Engineering αCLDN6×αCD3 bsAbs to Optimize Redirected T Cell Cytotoxicity on CLDN6-Expressing Cells αCLDN6×αCD3 bsAbs were engineered with various tuned CLDN6 and CD3 binding domains and in different bispecific formats and produced as generally described in Example 1 to optimize redirected T cell cytoxicity (RTCC), CLDN6 selectivity, and potential therapeutic index.

1. αCLDN6×αCD3 bsAbs with Bivalent CLDN6 Binding are Enhanced in Redirected T Cell Cytotoxicity (RTCC) on CLDN6+ Cells αCLDN6×αCD3 bsAbs were engineered using C6-24_H1L1, C6-30_H1L1, and C6-30_H2L1 in 1+1 Fab-scFv-Fc and 2+1 Fab2-scFv-Fc formats to investigate the impact of avidity (i.e. monovalent vs. bivalent binding of CLDN6 antigen). PA-1 cells (CLDN6hi; $1.1 \times 10^6$ CLDN6 density) were incubated with T cells isolated from human PBMCs at a 10:1 effector:target ratio for 48 hours. Data showing RTCC activity (as indicated by percentage dead cells and T cell activation) are depicted in FIGS. 37-38. The 2+1 Fab2-scFv-Fc constructs showed 20-100 fold lower EC50 in comparison to 1+1 constructs. Additionally, potency shifts between the 2+1 vs. 1+1 construct were half-log more for C6-30_H2L1 in comparison to C6-30_H1L1. Collectively, the data indicate that bsAbs with bivalent CLDN6 binding are enhanced in RTCC on CLDN6+ target cells.

2. αCLDN6×αCD3 bsAbs with Bivalent CLDN6 Binding and Lower Affinity CD3 Binding are Enhanced in Selectivity for CLDN6 Over CLDN9

Next, αCLDN6×αCD3 bsAbs having C6-30_H2L1 and either high affinity CD3 High or lower affinity CD3 High-Int #1 and in either 1+1 Fab-scFv-Fc or 2+1 Fab2-scFv-Fc formats were investigated for their selectivity for CLDN6+ target cells. HUTU-80 cells (CLDN6+) or HEK293-TREX cells stably transfected to express CLDN9 were incubated with T cells purified from human PBMCs at a 10:1 effector:target ratio for 48 hours. Comparator bsAb XENP26849 was also used. Data showing RTCC activity (as indicated by percentage dead cells and T cell activation) are depicted in FIGS. 39-40. Surprisingly, induction of RTCC activity on HUTU-80 cells by bsAbs having high affinity CD3_High only differed slightly than by bsAbs having lower affinity CD3 High-Int #1. However, consistent with Example 3A, the 2+1 format enabled much more potent RTCC activity in comparison to the 1+1 format. Notably, 2+1 Fab2-scFv-Fc bsAb having the lower affinity CD3 High-Int #1 induced RTCC on off-target CLDN9+ cells less potently than 2+1 bsAbs having high affinity CD3_High, indicating that using lower affinity CD3 binding domains in the context of a 2+1 Fab2-scFv-Fc format favorably improves selectivity for CLDN6 over CLDN9 expressing cells. Further, each of the bsAbs based on C6-30 demonstrated much weaker induction of RTCC on CLDN9 expressing cells in comparison to comparator bsAb XENP26849.

3. αCLDN6×αCD3 bsAb Activity Correlates with CLDN6 Antigen Density and CD3 Binding Affinity Next, RTCC activity on cell lines having different CLDN6 densities was investigated. 30K PA-1 ($1.1 \times 10^6$ CLDN6 density), OV-90 (195K CLDN6 density), NEC-8 (175K CLDN6 density), and COV-318 (11K CLDN6 density) cells were incubated with T cells purified from human PBMCs at a 10:1 E:T ratio for 48 hours. RTCC activity (as indicated by percentage dead cells and T cell activation) are depicted in FIGS. 41-44. The data show that cell killing activity and T cell activation correlates with CLDN6 antigen density and affinity of the CD3 binding domain. Selectivity for higher CLDN6 antigen density over lower CLDN6 antigen density suggests potential reduced off-target killing of healthy tissue expressing low levels of CLDN6 in a clinical setting and improved therapeutic index.

4. Tuning αCLDN6×αCD3 bsAb Activity and Selectivity

αCLDN6×αCD3 bsAbs were further tuned by incorporating the lead selectivity-tuned CLDN6 binding domains (as described in Example 2) into the 2+1 Fab2-scFv-Fc format with CD3_High-Int #1.

30K HUTU-80 (CLDN6+) or HEK293TREX cells stably transfected to express CLDN9 were incubated with T cells purified from human PBMC and test articles for 48 hours. In a first experiment, 10:1 effector:target ratio was used, data for which are depicted in FIG. 45. In a second experiment, 1:1 effector:target ratio was used, data for which are depicted in FIG. 46. Consistent with the data in Example 2.6, the bsAbs having selectivity-engineered CLDN6 binding domains demonstrated modulated activity on CLDN6+ cells and/or modulated activity on CLDN9+ cells in comparison to bsAbs having the parental C6-30_H1L1 and C6-30_H2L1. In one instance, XENP37233 demonstrated similar activity on CLDN9+ cells but significantly enhanced activity on CLDN6+ cells in comparison to the parental clones. In another instance, XENP37227 demonstrated reduced activity on CLDN9+ cells and enhanced activity on CLDN6+ cells (in comparison to the parental clones. In yet another instance, XENP37231 demonstrated little to no activity on CLDN9+ cells but slightly reduced activity on CLDN6+ cells in comparison to the parental clones. Each of these bsAbs may be suitable depending on whether clinical development favors enhanced activity on CLDN6+ cells, reduced activity on CLDN9+ cells, or preferably a balance of the two. Additionally in the second experiment, activation of T cells as indicated by CD69 expression, CD107a expression, and cytokine (IFNγ, IL-2, and TNFα) secretion was also determined as depicted in FIGS. 47-51, and the observations are consistent with the cell killing data.

FIG. 52 additionally depicts overlay of RTCC activity on HUTU-80 vs. on HEK293TREX expressing CLDN9 cells. The data show that each bsAb can be dosed at high concentrations to achieve efficacious killing of CLDN6+ cells while avoiding killing of CLDN9+ cells.

In another experiment, the RTCC activity of the bsAbs described above on PA-1 cells were compared to XENP37630 (sequences for which are depicted in FIG. 59) having the same CLDN6 binding domain as XENP37227 (i.e. C6-30_H1.9_L1.187) and lower affinity CD3 scFv (i.e. CD3_High-Int #2). Cell kill and T cell activation (as indicated by CD25 and CD107a expression) are depicted in FIG. 53 and show that each of the 4 bsAbs achieved efficacious target cell killing at high concentrations, with potencies ranked as XENP37223 (highest potency)>XENP37227>XENP37630>XENP37231 (lowest potency).

D. Example 4: Further Characterization of αCLDN6×αCD3 bsAbs of the Invention

Based on the above in vitro experiments, several bsAbs were selected for further analysis in vivo. These antibodies were further engineered with Xtend Fc (M428L/N434S) to enhanced serum half-life, illustrative sequences for which are depicted in FIGS. 22 and 59 as XENP37547 (Xtend analog to XENP37233), XENP37545 (Xtend analog to XENP37231), XENP37634 (Xtend analog to XENP37630), and XENP37541 (Xtend analog to XENP37227).

1. αCLDN6×αCD3 bsAbs Kill Cells Representative of CLDN6 in Tumors

In order to confirm the ability of αCLDN6×αCD3 bsAbs to effectively target cell lines expressing levels of CLDN6 antigen that are biologically relevant to tumor cells, IHC was conducted on biopsy cores of ovarian cancers and were qualitatively scored on a scale of 0-3 with 0 representing little to no target antigen expression and 3 representing high target antigen expression (herein referred to as IHC score). While there was significant variation among different types of ovarian cancers, many had IHC scores in the 1-2 range, representing approximately 200 k or fewer CLDN6 antigens per cell. For this reason, PA-1 cells were genetically engineered to express CLDN6 at a lower range of densities. Engineered PA-1 cell lines were established to express either 47 k, 55 k, 77 k, 105 k, 212 k, or 228 k CLDN6 antigens per cell approximately. A cell binding experiment was performed in which XENP37541 was incubated with each of the lower density PA-1 cell lines. Cell lines were then washed, stained with secondary antibody, and washed again before measuring binding by flow cytometry. As seen in FIG. 54, the level of binding is dependent on the density of CLDN6 expression, but XENP37541 is still capable of binding to cells with lower levels of CLDN6 expression, even down to 47 k CLDN6 antigens per cell.

Next, αCLDN6×αCD3 bsAbs XENP37541, XENP37634, and XENP37545, along with XENP32140 (a negative control RSV×CD3 bsAb), were tested for their ability to induce RTCC on these lower CLDN6 density PA-1 cell lines. A 1:1 effector:target cell ratio was used, along with the test articles at the range of concentrations indicated in FIG. 55. After a 72 hour incubation, results were measured as depicted in FIG. 55, and showed that XENP37541, XENP37634, and XENP37545 are all able to effectively induce RTCC in a CLDN6 density dependent manner even at a lower CLDN6 expression levels. The results showed that XENP37541 had the strongest potency and lowest EC50 values across all CLDN6 densities.

2. αCLDN6×αCD3 bsAbs Enhance Allogeneic Anti-Tumor Effect of T Cells In Vivo

NOD SCID gamma (NSG) mice (n=10) were engrafted intradermally with $10\times10^6$ PA-1 cells (in Matrigel) on Day −7. On Day 0, mice were engrafted intraperitoneally with $5\times10^6$ human PBMCs. Mice were then treated on Days 0, 7, 14, and 21 with XENP37233, XENP37227, XENP37630, or XENP37231 at 0.3, 1.0, or 3.0 mg/kg or PBS control. Tumor volume was measured by caliper three times per week (data for which are shown in FIG. 56) and blood was drawn to investigate lymphocyte expansion (data not shown). The data show that each of the 4 bsAbs were able to induce anti-tumor effect at all concentrations. By Day 14, each of the bispecific antibodies enhanced anti-tumor activity in comparison to PBS control. Notably, lower potency molecules XENP37630 and XENP37231 demonstrated some dose dependency in anti-tumor activity.

3. αCLDN6×αCD3 bsAbs are Well Tolerated and Demonstrate Good Pharmacokinetic Profile in Cynomolgus Monkeys Animals (n=1) were dosed with XENP37547, XENP37545, XENP37634, and XENP37541 at 1×, 10×, 30×, and 60× dose on Day 0. Blood was drawn over time to determine concentration of drug in serum over time, data for which are depicted in FIGS. 57-58. The data show that the bsAbs have an in vivo half-life of ~2 weeks and was dose dependent. Additionally, the bsAbs were generally well-tolerated as indicated by clinical observations (e.g. of body weight; data not shown).

SEQUENCE LISTING (580 sequences)

SEQ ID NO: 1 - protein, 20 aa, Artificial Sequence
  Description of Artificial Sequence: Synthetic peptide
  Positive Charged scFv Linkers +H
GKPGSGKPGSGKPGSGKPGS

SEQ ID NO: 2 - protein, 5 aa, Artificial Sequence
  Description of Artificial Sequence: Synthetic peptide
  See specification as filed for detailed description of substitutions and preferred embodiments
GGGGS

SEQ ID NO: 3 - protein, 5 aa, Artificial Sequence
  Description of Artificial Sequence: Synthetic peptide
  See specification as filed for detailed description of substitutions and preferred embodiments
GSGGS

SEQ ID NO: 4 - protein, 4 aa, Artificial Sequence
  Description of Artificial Sequence: Synthetic peptide
  See specification as filed for detailed description of substitutions and preferred embodiments
GGGS

SEQ ID NO: 5 - protein, 5 aa, Artificial Sequence
  Description of Artificial Sequence: Synthetic peptide
  Domain linker
GGGGS

SEQ ID NO: 6 - protein, 15 aa, Artificial Sequence
  Description of Artificial Sequence: Synthetic peptide
  Positive Charged scFv Linkers Gly-Ser 15
GGGGSGGGGSGGGGS

SEQ ID NO: 7 - protein, 18 aa, Artificial Sequence
  Description of Artificial Sequence: Synthetic peptide
  Positive Charged scFv Linkers Whitlow linker
GSTSGSGKPGSGEGSTKG

SEQ ID NO: 8 - protein, 14 aa, Artificial Sequence
  Description of Artificial Sequence: Synthetic peptide
  Positive Charged scFv Linkers 6paxA_1 (+A)
IRPRAIGGSKPRVA

SEQ ID NO: 9 - protein, 15 aa, Artificial Sequence
  Description of Artificial Sequence: Synthetic peptide
  Positive Charged scFv Linkers +B
GKGGSGKGGSGKGGS

SEQ ID NO: 10 - protein, 15 aa, Artificial Sequence
  Description of Artificial Sequence: Synthetic peptide
  Positive Charged scFv Linkers +C
GGKGSGGKGSGGKGS

SEQ ID NO: 11 - protein, 15 aa, Artificial Sequence
  Description of Artificial Sequence: Synthetic peptide
  Positive Charged scFv Linkers +D
GGGKSGGGKSGGGKS

SEQ ID NO: 12 - protein, 15 aa, Artificial Sequence
  Description of Artificial Sequence: Synthetic peptide
  Positive Charged scFv Linkers +E
GKGKSGKGKSGKGKS

SEQ ID NO: 13 - protein, 15 aa, Artificial Sequence
  Description of Artificial Sequence: Synthetic peptide
  Positive Charged scFv Linkers +F
GGGKSGGKGSGKGGS

SEQ ID NO: 14 - protein, 15 aa, Artificial Sequence
  Description of Artificial Sequence: Synthetic peptide
  Positive Charged scFv Linkers +G
GKPGSGKPGSGKPGS

SEQ ID NO: 15 - protein, 20 aa, Artificial Sequence
  Description of Artificial Sequence: Synthetic peptide
  scFv Linker
GKPGSGKPGSGKPGSGKPGS

SEQ ID NO: 16 - protein, 20 aa, Artificial Sequence
  Description of Artificial Sequence: Synthetic peptide
  Positive Charged scFv Linkers +I
GKGKSGKGKSGKGKSGKGKS

SEQ ID NO: 17 - protein, 20 aa, Artificial Sequence
  Description of Artificial Sequence: Synthetic peptide
  Negative Charged scFv Linkers Gly-Ser 20
GGGGSGGGGSGGGGSGGGGS

SEQ ID NO: 18 - protein, 14 aa, Artificial Sequence
  Description of Artificial Sequence: Synthetic peptide
  Negative Charged scFv Linkers 3hsc_2 (-A)
STAGDTHLGGEDFD

SEQ ID NO: 19 - protein, 15 aa, Artificial Sequence
  Description of Artificial Sequence: Synthetic peptide
  Negative Charged scFv Linkers -B
GEGGSGEGGSGEGGS

SEQ ID NO: 20 - protein, 15 aa, Artificial Sequence
  Description of Artificial Sequence: Synthetic peptide
  Negative Charged scFv Linkers -C
GGEGSGGEGSGGEGS

SEQ ID NO: 21 - protein, 15 aa, Artificial Sequence
  Description of Artificial Sequence: Synthetic peptide
  Negative Charged scFv Linkers -D
GGGESGGGESGGGES

SEQ ID NO: 22 - protein, 15 aa, Artificial Sequence
  Description of Artificial Sequence: Synthetic peptide
  Negative Charged scFv Linkers -E
GEGESGEGESGEGES

SEQ ID NO: 23 - protein, 15 aa, Artificial Sequence
  Description of Artificial Sequence: Synthetic peptide
  Negative Charged scFv Linkers -F
GGGESGGEGSGEGGS

SEQ ID NO: 24 - protein, 20 aa, Artificial Sequence
  Description of Artificial Sequence: Synthetic peptide
  Negative Charged scFv Linkers -G
GEGESGEGESGEGESGEGES

SEQ ID NO: 25 - protein, 15 aa, Artificial Sequence
  Description of Artificial Sequence: Synthetic peptide
  scFv Linker
GGGGSGGGGSGGGGS

SEQ ID NO: 26 - protein, 20 aa, Artificial Sequence
  Description of Artificial Sequence: Synthetic peptide
  scFv Linker
GGGGSGGGGSGGGGSGGGGS

SEQ ID NO: 27 - protein, 18 aa, Artificial Sequence
  Description of Artificial Sequence: Synthetic peptide
  scFv Linker
GSTSGSGKPGSGEGSTKG

SEQ ID NO: 28 - protein, 19 aa, Artificial Sequence
  Description of Artificial Sequence: Synthetic peptide
  scFv Linker
PRGASKSGSASQTGSAPGS

SEQ ID NO: 29 - protein, 19 aa, Artificial Sequence
  Description of Artificial Sequence: Synthetic peptide
  scFv Linker
GTAAAGAGAAGGAAAGAAG

SEQ ID NO: 30 - protein, 19 aa, Artificial Sequence
  Description of Artificial Sequence: Synthetic peptide
  scFv Linker
GTSGSSGSGSGGSGSGGGG

SEQ ID NO: 31 - protein, 10 aa, Artificial Sequence
  Description of Artificial Sequence: Synthetic peptide
  Domain linker
GGGGSGGGGS

SEQ ID NO: 32 - protein, 15 aa, Artificial Sequence
  Description of Artificial Sequence: Synthetic peptide
  Domain linker
GGGGSGGGGSGGGGS

SEQ ID NO: 33 - protein, 20 aa, Artificial Sequence
  Description of Artificial Sequence: Synthetic peptide
  Domain linker
GGGGSGGGGSGGGGSGGGGS

SEQ ID NO: 34 - protein, 25 aa, Artificial Sequence
  Description of Artificial Sequence: Synthetic peptide
  Domain linker
GGGGSGGGGSGGGGSGGGGSGGGGS

SEQ ID NO: 35 - protein, 30 aa, Artificial Sequence
  Description of Artificial Sequence: Synthetic polypeptide
  Domain linker
GGGGSGGGGSGGGGSGGGGSGGGGSGGGGS

SEQ ID NO: 36 - protein, 35 aa, Artificial Sequence
  Description of Artificial Sequence: Synthetic polypeptide
  Domain linker
GGGGSGGGGSGGGGSGGGGSGGGGSGGGGSGGGGS

SEQ ID NO: 37 - protein, 5 aa, Artificial Sequence
  Description of Artificial Sequence: Synthetic peptide
  Domain linker
GGGGA

SEQ ID NO: 38 - protein, 10 aa, Artificial Sequence
  Description of Artificial Sequence: Synthetic peptide
  Domain linker
GGGGAGGGGA

SEQ ID NO: 39 - protein, 15 aa, Artificial Sequence
  Description of Artificial Sequence: Synthetic peptide
  Domain linker
GGGGAGGGGAGGGGA

SEQ ID NO: 40 - protein, 20 aa, Artificial Sequence
  Description of Artificial Sequence: Synthetic peptide
  Domain linker
GGGGAGGGGAGGGGAGGGGA

SEQ ID NO: 41 - protein, 25 aa, Artificial Sequence
  Description of Artificial Sequence: Synthetic peptide
  Domain linker
GGGGAGGGGAGGGGAGGGGAGGGGA

SEQ ID NO: 42 - protein, 30 aa, Artificial Sequence
  Description of Artificial Sequence: Synthetic polypeptide
  Domain linker
GGGGAGGGGAGGGGAGGGGAGGGGAGGGGA

SEQ ID NO: 43 - protein, 35 aa, Artificial Sequence
  Description of Artificial Sequence: Synthetic polypeptide
  Domain linker
GGGGAGGGGAGGGGAGGGGAGGGGAGGGGAGGGGA

SEQ ID NO: 44 - protein, 30 aa, Artificial Sequence
  Description of Artificial Sequence: Synthetic polypeptide
  Domain linker 30AA-linker
DPALVHQRPAPPGGGGSGGGGSGGGGSGGG

SEQ ID NO: 45 - protein, 5 aa, Artificial Sequence
  Description of Artificial Sequence: Synthetic peptide
  Domain linker
GKPGS

SEQ ID NO: 46 - protein, 25 aa, Artificial Sequence
  Description of Artificial Sequence: Synthetic peptide
  Domain linker
GKPGSGKPGSGKPGSGKPGSGKPGS

SEQ ID NO: 47 - protein, 30 aa, Artificial Sequence
  Description of Artificial Sequence: Synthetic polypeptide
  Domain linker
GKPGSGKPGSGKPGSGKPGSGKPGSGKPGS

SEQ ID NO: 48 - protein, 5 aa, Artificial Sequence
  Description of Artificial Sequence: Synthetic peptide
  Domain linker
GGGES

SEQ ID NO: 49 - protein, 9 aa, Artificial Sequence
  Description of Artificial Sequence: Synthetic peptide
  Domain linker "half hinge"
KTHTCPPCP

SEQ ID NO: 50 - protein, 15 aa, Artificial Sequence
  Description of Artificial Sequence: Synthetic peptide
  Domain linker "full hinge C220S variant"
EPKSSDKTHTCPPCP

SEQ ID NO: 51 - protein, 19 aa, Artificial Sequence
  Description of Artificial Sequence: Synthetic peptide
  Domain linker "flex half hinge"
GGGGSGGGGSKTHTCPPCP

SEQ ID NO: 52 - protein, 19 aa, Artificial Sequence
  Description of Artificial Sequence: Synthetic peptide
  Domain linker "charged half hinge1"
GKPGSGKPGSKTHTCPPCP

SEQ ID NO: 53 - protein, 14 aa, Artificial Sequence
  Description of Artificial Sequence: Synthetic peptide
  Domain linker "charged half hinge2"
GKPGSKTHTCPPCP

SEQ ID NO: 54 - protein, 329 aa, Artificial Sequence
  Description of Artificial Sequence: Synthetic polypeptide
  1 + 1 Fab-scFv-Fc Backbone 1 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 55 - protein, 231 aa, Artificial Sequence
  Description of Artificial Sequence: Synthetic polypeptide
  1 + 1 Fab-scFv-Fc Backbone 1 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 329 aa, Artificial Sequence; identical to SEQ ID NO: 54
  Description of Artificial Sequence: Synthetic polypeptide
  1 + 1 Fab-scFv-Fc Backbone 2 Fab-Fc Side

SEQ ID NO: 57 - protein, 231 aa, Artificial Sequence
  Description of Artificial Sequence: Synthetic polypeptide
  1 + 1 Fab-scFv-Fc Backbone 2 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 329 aa, Artificial Sequence
  Description of Artificial Sequence: Synthetic polypeptide
  1 + 1 Fab-scFv-Fc Backbone 3 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 59 - protein, 231 aa, Artificial Sequence; identical to SEQ ID NO: 57
  Description of Artificial Sequence: Synthetic polypeptide
  1 + 1 Fab-scFv-Fc Backbone 3 scFv-Fc Side

SEQ ID NO: 60 - protein, 329 aa, Artificial Sequence
  Description of Artificial Sequence: Synthetic polypeptide
  1 + 1 Fab-scFv-Fc Backbone 4 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 61 - protein, 231 aa, Artificial Sequence
  Description of Artificial Sequence: Synthetic polypeptide
  1 + 1 Fab-scFv-Fc Backbone 4 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 62 - protein, 329 aa, Artificial Sequence
  Description of Artificial Sequence: Synthetic polypeptide
  1 + 1 Fab-scFv-Fc Backbone 5 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 63 - protein, 231 aa, Artificial Sequence
  Description of Artificial Sequence: Synthetic polypeptide
  1 + 1 Fab-scFv-Fc Backbone 5 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 329 aa, Artificial Sequence
  Description of Artificial Sequence: Synthetic polypeptide
  1 + 1 Fab-scFv-Fc Backbone 6 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 65 - protein, 231 aa, Artificial Sequence
  Description of Artificial Sequence: Synthetic polypeptide
  1 + 1 Fab-scFv-Fc Backbone 6 scFv-Fc Side
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 329 aa, Artificial Sequence
  Description of Artificial Sequence: Synthetic polypeptide
  1 + 1 Fab-scFv-Fc Backbone 7 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 67 - protein, 231 aa, Artificial Sequence
  Description of Artificial Sequence: Synthetic polypeptide
  1 + 1 Fab-scFv-Fc Backbone 7 scFv-Fc Side
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 327 aa, Artificial Sequence
  Description of Artificial Sequence: Synthetic polypeptide
  1 + 1 Fab-scFv-Fc Backbone 8 Fab-Fc Side
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 69 - protein, 229 aa, Artificial Sequence
  Description of Artificial Sequence: Synthetic polypeptide
  1 + 1 Fab-scFv-Fc Backbone 8 scFv-Fc Side
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 70 - protein, 326 aa, Artificial Sequence
  Description of Artificial Sequence: Synthetic polypeptide
  1 + 1 Fab-scFv-Fc Backbone 9 Fab-Fc Side
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 71 - protein, 228 aa, Artificial Sequence
  Description of Artificial Sequence: Synthetic polypeptide
  1 + 1 Fab-scFv-Fc Backbone 9 scFv-Fc Side
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 72 - protein, 326 aa, Artificial Sequence
  Description of Artificial Sequence: Synthetic polypeptide
  1 + 1 Fab-scFv-Fc Backbone 10 Fab-Fc Side
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 73 - protein, 228 aa, Artificial Sequence
  Description of Artificial Sequence: Synthetic polypeptide
  1 + 1 Fab-scFv-Fc Backbone 10 scFv-Fc Side
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 74 - protein, 329 aa, Artificial Sequence
  Description of Artificial Sequence: Synthetic polypeptide
  1 + 1 Fab-scFv-Fc Backbone 11 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 75 - protein, 231 aa, Artificial Sequence
  Description of Artificial Sequence: Synthetic polypeptide
  1 + 1 Fab-scFv-Fc Backbone 11 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 76 - protein, 329 aa, Artificial Sequence
  Description of Artificial Sequence: Synthetic polypeptide
  1 + 1 Fab-scFv-Fc Backbone 12 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVAGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 231 aa, Artificial Sequence
  Description of Artificial Sequence: Synthetic polypeptide
  1 + 1 Fab-scFv-Fc Backbone 12 scFv-Fc Side
ERKSSDKTHTCPPRPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 329 aa, Artificial Sequence; identical to SEQ ID NO: 54
  Description of Artificial Sequence: Synthetic polypeptide
  2 + 1 Fab2-scFv-Fc Backbone 1 Fab-Fc Side

SEQ ID NO: 79 - protein, 216 aa, Artificial Sequence
  Description of Artificial Sequence: Synthetic polypeptide
  2 + 1 Fab2-scFv-Fc Backbone 1 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 329 aa, Artificial Sequence; identical to SEQ ID NO: 54
  Description of Artificial Sequence: Synthetic polypeptide
  2 + 1 Fab2-scFv-Fc Backbone 2 Fab-Fc Side

SEQ ID NO: 81 - protein, 216 aa, Artificial Sequence
  Description of Artificial Sequence: Synthetic polypeptide
  2 + 1 Fab2-scFv-Fc Backbone 2 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 329 aa, Artificial Sequence; identical to SEQ ID NO: 58
  Description of Artificial Sequence: Synthetic polypeptide
  2 + 1 Fab2-scFv-Fc Backbone 3 Fab-Fc Side

SEQ ID NO: 83 - protein, 216 aa, Artificial Sequence; identical to SEQ ID NO: 81
  Description of Artificial Sequence: Synthetic polypeptide
  2 + 1 Fab2-scFv-Fc Backbone 3 Fab-scFv-Fc Side

SEQ ID NO: 84 - protein, 329 aa, Artificial Sequence; identical to SEQ ID NO: 60
  Description of Artificial Sequence: Synthetic polypeptide
  2 + 1 Fab2-scFv-Fc Backbone 4 Fab-Fc Side

SEQ ID NO: 85 - protein, 216 aa, Artificial Sequence
  Description of Artificial Sequence: Synthetic polypeptide
  2 + 1 Fab2-scFv-Fc Backbone 4 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 86 - protein, 329 aa, Artificial Sequence; identical to SEQ ID NO: 62
  Description of Artificial Sequence: Synthetic polypeptide
  2 + 1 Fab2-scFv-Fc Backbone 5 Fab-Fc Side

SEQ ID NO: 87 - protein, 216 aa, Artificial Sequence
  Description of Artificial Sequence: Synthetic polypeptide
  2 + 1 Fab2-scFv-Fc Backbone 5 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 329 aa, Artificial Sequence; identical to SEQ ID NO: 64
  Description of Artificial Sequence: Synthetic polypeptide
  2 + 1 Fab2-scFv-Fc Backbone 6 Fab-Fc Side

SEQ ID NO: 89 - protein, 216 aa, Artificial Sequence
  Description of Artificial Sequence: Synthetic polypeptide
  2 + 1 Fab2-scFv-Fc Backbone 6 Fab-scFv-Fc Side
APPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 329 aa, Artificial Sequence; identical to SEQ ID NO: 66
  Description of Artificial Sequence: Synthetic polypeptide
  2 + 1 Fab2-scFv-Fc Backbone 7 Fab-Fc Side

SEQ ID NO: 91 - protein, 216 aa, Artificial Sequence
  Description of Artificial Sequence: Synthetic polypeptide
  2 + 1 Fab2-scFv-Fc Backbone 7 Fab-scFv-Fc Side
APPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 329 aa, Artificial Sequence; identical to SEQ ID NO: 74
  Description of Artificial Sequence: Synthetic polypeptide
  2 + 1 Fab2-scFv-Fc Backbone 8 Fab-Fc Side

SEQ ID NO: 93 - protein, 216 aa, Artificial Sequence
  Description of Artificial Sequence: Synthetic polypeptide
  2 + 1 Fab2-scFv-Fc Backbone 8 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 94 - protein, 329 aa, Artificial Sequence; identical to SEQ ID NO: 76
  Description of Artificial Sequence: Synthetic polypeptide
  2 + 1 Fab2-scFv-Fc Backbone 9 Fab-Fc Side

SEQ ID NO: 95 - protein, 216 aa, Artificial Sequence
  Description of Artificial Sequence: Synthetic polypeptide
  2 + 1 Fab2-scFv-Fc Backbone 9 Fab-scFv-Fc Side
APPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 107 aa, Artificial Sequence [sequence omitted]

SEQ ID NO: 97 - protein, 106 aa, Artificial Sequence
  Description of Artificial Sequence: Synthetic polypeptide
  Constant Light Domain - Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 98 - protein, 254 aa, Artificial Sequence
  Description of Artificial Sequence: Synthetic polypeptide
  CD3 High - [anti-CD3]_H1.30_L1.47_scFv scFv (VHVL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 99 - protein, 254 aa, Artificial Sequence
  Description of Artificial Sequence: Synthetic polypeptide
  CD3 High - [anti-CD3]_H1.30_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 100 - protein, 125 aa, Artificial Sequence
  Description of Artificial Sequence: Synthetic polypeptide
  CD3 High - [anti-CD3]_H1.30_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 101 - protein, 5 aa, Artificial Sequence
  Description of Artificial Sequence: Synthetic peptide
  CD3 High - [anti-CD3]_H1.30_L1.47_scFv vhCDR1
TYAMN

SEQ ID NO: 102 - protein, 19 aa, Artificial Sequence
  Description of Artificial Sequence: Synthetic peptide
  CD3 High - [anti-CD3]_H1.30_L1.47_scFv vhCDR2
RIRSKYNNYATYYADSVKG

SEQ ID NO: 103 - protein, 14 aa, Artificial Sequence
  Description of Artificial Sequence: Synthetic peptide
  CD3 High - [anti-CD3]_H1.30_L1.47_scFv vhCDR3
HGNFGDSYVSWFAY

SEQ ID NO: 104 - protein, 109 aa, Artificial Sequence
  Description of Artificial Sequence: Synthetic polypeptide
  CD3 High - [anti-CD3]_H1.30_L1.47_scFv Variable Light (vl) Domain
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 105 - protein, 14 aa, Artificial Sequence
  Description of Artificial Sequence: Synthetic peptide
  CD3 High - [anti-CD3]_H1.30_L1.47_scFv vlCDR1
GSSTGAVTTSNYAN

SEQ ID NO: 106 - protein, 7 aa, Artificial Sequence
  Description of Artificial Sequence: Synthetic peptide
  CD3 High - [anti-CD3]_H1.30_L1.47_scFv vlCDR2
GTNKRAP

SEQ ID NO: 107 - protein, 9 aa, Artificial Sequence
  Description of Artificial Sequence: Synthetic peptide
  CD3 High - [anti-CD3]_H1.30_L1.47_scFv vlCDR3
ALWYSNHWV

SEQ ID NO: 108 - protein, 20 aa, Artificial Sequence
  Description of Artificial Sequence: Synthetic peptide
  CD3 High - [anti-CD3]_H1.30_L1.47_scFv Linker
GKPGSGKPGSGKPGSGKPGS

SEQ ID NO: 109 - protein, 254 aa, Artificial Sequence
  Description of Artificial Sequence: Synthetic polypeptide
  CD3 High-Int #1 - [anti-CD3]_H1.32_L1.47_scFv scFv (VHVL)
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 110 - protein, 254 aa, Artificial Sequence
  Description of Artificial Sequence: Synthetic polypeptide
  CD3 High-Int #1 - [anti-CD3]_H1.32_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 111 - protein, 125 aa, Artificial Sequence
  Description of Artificial Sequence: Synthetic polypeptide
  CD3 High-Int #1 - [anti-CD3]_H1.32_L1.47_scFv Variable Heavy (vh) Domain
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 112 - protein, 5 aa, Artificial Sequence
  Description of Artificial Sequence: Synthetic peptide
  CD3 High-Int #1 - [anti-CD3]_H1.32_L1.47_scFv vhCDR1
TYAMN

SEQ ID NO: 113 - protein, 19 aa, Artificial Sequence
  Description of Artificial Sequence: Synthetic peptide
  CD3 High-Int #1 - [anti-CD3]_H1.32_L1.47_scFv vhCDR2
RIRSKANNYATYYADSVKG

SEQ ID NO: 114 - protein, 14 aa, Artificial Sequence
  Description of Artificial Sequence: Synthetic peptide
  CD3 High-Int #1 - [anti-CD3]_H1.32_L1.47_scFv vhCDR3
HGNFGDSYVSWFAY

SEQ ID NO: 115 - protein, 109 aa, Artificial Sequence; identical to SEQ ID NO: 104
  Description of Artificial Sequence: Synthetic polypeptide
  CD3 High-Int #1 - [anti-CD3]_H1.32_L1.47_scFv Variable Light (vl) Domain

SEQ ID NO: 116 - protein, 14 aa, Artificial Sequence
  Description of Artificial Sequence: Synthetic peptide
  CD3 High-Int #1 - [anti-CD3]_H1.32_L1.47_scFv vlCDR1
GSSTGAVTTSNYAN

SEQ ID NO: 117 - protein, 7 aa, Artificial Sequence
  Description of Artificial Sequence: Synthetic peptide
  CD3 High-Int #1 - [anti-CD3]_H1.32_L1.47_scFv vlCDR2
GTNKRAP

SEQ ID NO: 118 - protein, 9 aa, Artificial Sequence
  Description of Artificial Sequence: Synthetic peptide
  CD3 High-Int #1 - [anti-CD3]_H1.32_L1.47_scFv vlCDR3
ALWYSNHWV

SEQ ID NO: 119 - protein, 20 aa, Artificial Sequence
  Description of Artificial Sequence: Synthetic peptide
  CD3 High-Int #1 - [anti-CD3]_H1.32_L1.47_scFv Linker
GKPGSGKPGSGKPGSGKPGS

SEQ ID NO: 120 - protein, 254 aa, Artificial Sequence
  Description of Artificial Sequence: Synthetic polypeptide
  CD3 High-Int #2 - [anti-CD3]_H1.89_L1.47_scFv scFv (VHVL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 121 - protein, 254 aa, Artificial Sequence
  Description of Artificial Sequence: Synthetic polypeptide
  CD3 High-Int #2 - [anti-CD3]_H1.89_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 122 - protein, 125 aa, Artificial Sequence
  Description of Artificial Sequence: Synthetic polypeptide
  CD3 High-Int #2 - [anti-CD3]_H1.89_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 123 - protein, 5 aa, Artificial Sequence
  Description of Artificial Sequence: Synthetic peptide
  CD3 High-Int #2 - [anti-CD3]_H1.89_L1.47_scFv vhCDR1
TYAMN

SEQ ID NO: 124 - protein, 19 aa, Artificial Sequence
  Description of Artificial Sequence: Synthetic peptide
  CD3 High-Int #2 - [anti-CD3]_H1.89_L1.47_scFv vhCDR2
RIRSKYNNYATYYADSVKG

SEQ ID NO: 125 - protein, 14 aa, Artificial Sequence
  Description of Artificial Sequence: Synthetic peptide
  CD3 High-Int #2 - [anti-CD3]_H1.89_L1.47_scFv vhCDR3
HGNFGDEYVSWFAY

SEQ ID NO: 126 - protein, 109 aa, Artificial Sequence; identical to SEQ ID NO: 104
  Description of Artificial Sequence: Synthetic polypeptide
  CD3 High-Int #2 - [anti-CD3]_H1.89_L1.47_scFv Variable Light (vl) Domain

SEQ ID NO: 127 - protein, 14 aa, Artificial Sequence
  Description of Artificial Sequence: Synthetic peptide
  CD3 High-Int #2 - [anti-CD3]_H1.89_L1.47_scFv vlCDR1
GSSTGAVTTSNYAN

SEQ ID NO: 128 - protein, 7 aa, Artificial Sequence
  Description of Artificial Sequence: Synthetic peptide
  CD3 High-Int #2 - [anti-CD3]_H1.89_L1.47_scFv vlCDR2
GTNKRAP

SEQ ID NO: 129 - protein, 9 aa, Artificial Sequence
  Description of Artificial Sequence: Synthetic peptide
  CD3 High-Int #2 - [anti-CD3]_H1.89_L1.47_scFv vlCDR3
ALWYSNHWV

SEQ ID NO: 130 - protein, 20 aa, Artificial Sequence
  Description of Artificial Sequence: Synthetic peptide
  CD3 High-Int #2 - [anti-CD3]_H1.89_L1.47_scFv Linker
GKPGSGKPGSGKPGSGKPGS

SEQ ID NO: 131 - protein, 254 aa, Artificial Sequence
  Description of Artificial Sequence: Synthetic polypeptide
  CD3 High-Int #3 - [anti-CD3]_H1.90_L1.47_scFv scFv (VHVL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 132 - protein, 254 aa, Artificial Sequence
  Description of Artificial Sequence: Synthetic polypeptide
  CD3 High-Int #3 - [anti-CD3]_H1.90_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 133 - protein, 125 aa, Artificial Sequence
  Description of Artificial Sequence: Synthetic polypeptide
  CD3 High-Int #3 - [anti-CD3]_H1.90_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 134 - protein, 5 aa, Artificial Sequence
  Description of Artificial Sequence: Synthetic peptide
  CD3 High-Int #3 - [anti-CD3]_H1.90_L1.47_scFv vhCDR1
TYAMN

SEQ ID NO: 135 - protein, 19 aa, Artificial Sequence
  Description of Artificial Sequence: Synthetic peptide
  CD3 High-Int #3 - [anti-CD3]_H1.90_L1.47_scFv vhCDR2
RIRSKYNNYATYYADSVKG

SEQ ID NO: 136 - protein, 14 aa, Artificial Sequence
  Description of Artificial Sequence: Synthetic peptide
  CD3 High-Int #3 - [anti-CD3]_H1.90_L1.47_scFv vhCDR3
HGNFGDPYVSWFAY

SEQ ID NO: 137 - protein, 109 aa, Artificial Sequence; identical to SEQ ID NO: 104
  Description of Artificial Sequence: Synthetic polypeptide
  CD3 High-Int #3 - [anti-CD3]_H1.90_L1.47_scFv Variable Light (vl) Domain

SEQ ID NO: 138 - protein, 14 aa, Artificial Sequence
  Description of Artificial Sequence: Synthetic peptide
  CD3 High-Int #3 - [anti-CD3]_H1.90_L1.47_scFv vlCDR1
GSSTGAVTTSNYAN

SEQ ID NO: 139 - protein, 7 aa, Artificial Sequence
  Description of Artificial Sequence: Synthetic peptide
  CD3 High-Int #3 - [anti-CD3]_H1.90_L1.47_scFv vlCDR2
GTNKRAP

SEQ ID NO: 140 - protein, 9 aa, Artificial Sequence
  Description of Artificial Sequence: Synthetic peptide
  CD3 High-Int #3 - [anti-CD3]_H1.90_L1.47_scFv vlCDR3
ALWYSNHWV

SEQ ID NO: 141 - protein, 20 aa, Artificial Sequence
  Description of Artificial Sequence: Synthetic peptide
  CD3 High-Int #3 - [anti-CD3]_H1.90_L1.47_scFv Linker
GKPGSGKPGSGKPGSGKPGS

SEQ ID NO: 142 - protein, 254 aa, Artificial Sequence
  Description of Artificial Sequence: Synthetic polypeptide
  CD3-Intermediate - [anti-CD3]_H1.33_L1.47_scFv scFv (VHVL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 143 - protein, 254 aa, Artificial Sequence
  Description of Artificial Sequence: Synthetic polypeptide
  CD3-Intermediate - [anti-CD3]_H1.33_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 144 - protein, 125 aa, Artificial Sequence
  Description of Artificial Sequence: Synthetic polypeptide
  CD3-Intermediate - [anti-CD3]_H1.33_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 145 - protein, 5 aa, Artificial Sequence
  Description of Artificial Sequence: Synthetic peptide
  CD3-Intermediate - [anti-CD3]_H1.33_L1.47_scFv vhCDR1
TYAMN

SEQ ID NO: 146 - protein, 19 aa, Artificial Sequence
  Description of Artificial Sequence: Synthetic peptide
  CD3-Intermediate - [anti-CD3]_H1.33_L1.47_scFv vhCDR2
RIRSKYNNYATYYADSVKG

SEQ ID NO: 147 - protein, 14 aa, Artificial Sequence
  Description of Artificial Sequence: Synthetic peptide
  CD3-Intermediate - [anti-CD3]_H1.33_L1.47_scFv vhCDR3
HGNFGDSYVSWFDY

SEQ ID NO: 148 - protein, 109 aa, Artificial Sequence; identical to SEQ ID NO: 104
  Description of Artificial Sequence: Synthetic polypeptide
  CD3-Intermediate - [anti-CD3]_H1.33_L1.47_scFv Variable Light (vl) Domain

SEQ ID NO: 149 - protein, 14 aa, Artificial Sequence
  Description of Artificial Sequence: Synthetic peptide
  CD3-Intermediate - [anti-CD3]_H1.33_L1.47_scFv vlCDR1
GSSTGAVTTSNYAN

SEQ ID NO: 150 - protein, 7 aa, Artificial Sequence
  Description of Artificial Sequence: Synthetic peptide
  CD3-Intermediate - [anti-CD3]_H1.33_L1.47_scFv vlCDR2
GTNKRAP

SEQ ID NO: 151 - protein, 9 aa, Artificial Sequence
  Description of Artificial Sequence: Synthetic peptide
  CD3-Intermediate - [anti-CD3]_H1.33_L1.47_scFv vlCDR3
ALWYSNHWV

SEQ ID NO: 152 - protein, 20 aa, Artificial Sequence
  Description of Artificial Sequence: Synthetic peptide
  CD3-Intermediate - [anti-CD3]_H1.33_L1.47_scFv Linker
GKPGSGKPGSGKPGSGKPGS

SEQ ID NO: 153 - protein, 254 aa, Artificial Sequence
  Description of Artificial Sequence: Synthetic polypeptide
  CD3 Low - [anti-CD3]_H1.31_L1.47_scFv scFv (VHVL)
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 154 - protein, 254 aa, Artificial Sequence
  Description of Artificial Sequence: Synthetic polypeptide
  CD3 Low - [anti-CD3]_H1.31_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 155 - protein, 125 aa, Artificial Sequence
  Description of Artificial Sequence: Synthetic polypeptide
  CD3 Low - [anti-CD3]_H1.31_L1.47_scFv Variable Heavy (vh) Domain
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 156 - protein, 5 aa, Artificial Sequence
  Description of Artificial Sequence: Synthetic peptide
  CD3 Low - [anti-CD3]_H1.31_L1.47_scFv vhCDR1
TYAMS

SEQ ID NO: 157 - protein, 19 aa, Artificial Sequence
  Description of Artificial Sequence: Synthetic peptide
  CD3 Low - [anti-CD3]_H1.31_L1.47_scFv vhCDR2
RIRSKYNNYATYYADSVKG

SEQ ID NO: 158 - protein, 14 aa, Artificial Sequence
  Description of Artificial Sequence: Synthetic peptide
  CD3 Low - [anti-CD3]_H1.31_L1.47_scFv vhCDR3
HGNFGDSYVSWFAY

SEQ ID NO: 159 - protein, 109 aa, Artificial Sequence; identical to SEQ ID NO: 104
  Description of Artificial Sequence: Synthetic polypeptide
  CD3 Low - [anti-CD3]_H1.31_L1.47_scFv Variable Light (vl) Domain

SEQ ID NO: 160 - protein, 14 aa, Artificial Sequence
  Description of Artificial Sequence: Synthetic peptide
  CD3 Low - [anti-CD3]_H1.31_L1.47_scFv vlCDR1
GSSTGAVTTSNYAN

SEQ ID NO: 161 - protein, 7 aa, Artificial Sequence
  Description of Artificial Sequence: Synthetic peptide
  CD3 Low - [anti-CD3]_H1.31_L1.47_scFv vlCDR2
GTNKRAP

SEQ ID NO: 162 - protein, 9 aa, Artificial Sequence
  Description of Artificial Sequence: Synthetic peptide
  CD3 Low - [anti-CD3]_H1.31_L1.47_scFv vlCDR3
ALWYSNHWV

SEQ ID NO: 163 - protein, 20 aa, Artificial Sequence
  Description of Artificial Sequence: Synthetic peptide
  CD3 Low - [anti-CD3]_H1.31_L1.47_scFv Linker
GKPGSGKPGSGKPGSGKPGS

SEQ ID NO: 164 - protein, 220 aa, Homo sapiens
  Human CLDN6 sequence sp|P56747
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 165 - protein, 53 aa, Homo sapiens
  Human CLDN6 sequence, N-terminal extracellular domain sp|P56747| 29-81
MWKVTAFIGNSIVVAQVVWEGLWMSCVVQSTGQMQCKVYDSLLALPQDLQAAR

SEQ ID NO: 166 - protein, 23 aa, Homo sapiens
  Human CLDN6 sequence, C-terminal extracellular domain sp|P56747| 138-160
WTAHAIIRDFYNPLVAEAQKREL

SEQ ID NO: 167 - protein, 219 aa, Mus musculus
  Mouse CLDN6 sequence sp|Q9Z262
MASTGLQILGIVLTLLGWVNALVSCALPMWKVTAFIGNSIVVAQMVWEGLWMSCVVQSTGQMQCKVYDSLLALPQDLQAARALCVVTLLIVLLGLLVYLAGAKCTTCVEDRNSKSRLVLISGIIFVISGVLTLIPVCWTAHSIIQDFYNPLVADAQKRELGASLYLGWAASGLLLLGGGLLCCACSSGGTQGPRHYMACYSTSVPHSRGPSEYPTKNYV

SEQ ID NO: 168 - protein, 53 aa, Mus musculus
  Mouse CLDN6 sequence, N-terminal extracellular domain sp|Q9Z262| 29-81
MWKVTAFIGNSIVVAQMVWEGLWMSCVVQSTGQMQCKVYDSLLALPQDLQAAR

SEQ ID NO: 169 - protein, 26 aa, Mus musculus
  Mouse CLDN6 sequence, C-terminal extracellular domain sp|Q9Z262| 138-163
WTAHSIIQDFYNPLVADAQKRELGAS

SEQ ID NO: 170 - protein, 220 aa, Macaca fascicularis
  Macaca fascicularis CLDN6 sequence (predicted) tr|G7Q0B0
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSRGPSHYMARYSTSAPAISRGPSEYPTKNYV

SEQ ID NO: 171 - protein, 53 aa, Macaca fascicularis; identical to SEQ ID NO: 165
  Macaca fascicularis CLDN6 sequence, N-terminal extracellular domain (predicted) tr|G7Q0B0|29-81

SEQ ID NO: 172 - protein, 23 aa, Macaca fascicularis
  Macaca fascicularis CLDN6 sequence, C-terminal extracellular domain (predicted) tr|G7Q0B0|138-160
WTAHAIIRDFYNPLVAEAQKREL

SEQ ID NO: 173 - protein, 220 aa, Homo sapiens; identical to SEQ ID NO: 164
  cldn6

SEQ ID NO: 174 - protein, 217 aa, Homo sapiens
  cldn9
MASTGLELLGMTLAVLGWLGTLVSCALPLWKVTAFIGNSIVVAQVVWEGLWMSCVVQSTGQMQCKVYDSLLALPQDLQAARALCVIALLLALLGLLVAITGAQCTTCVEDEGAKARIVLTAGVILLLAGILVLIPVCWTAHAIIQDFYNPLVAEALKRELGASLYLGWAAAALLMLGGGLLCCTCPPPQVERPRGPRLGYSIPSRSGASGLDKRDYV

SEQ ID NO: 175 - protein, 120 aa, Artificial Sequence
  Description of Artificial Sequence: Synthetic polypeptide
  mC6-30[CLDN6] Variable heavy (vh) domain
EVQLQQSGPELVKPGASVKISCKTSGYTFTEYTMHWVKQSPGKSLEWIGGIDPNNGNTHYNQKFKGKATLTVDKSSSTAYMELRSLTSEDSAVYYCARIYYFGRLYFDFWGAGTTVTVSS

SEQ ID NO: 176 - protein, 5 aa, Artificial Sequence
  Description of Artificial Sequence: Synthetic peptide
  mC6-30[CLDN6] vhCDR1
EYTMH

SEQ ID NO: 177 - protein, 17 aa, Artificial Sequence
  Description of Artificial Sequence: Synthetic peptide
  mC6-30[CLDN6] vhCDR2
GIDPNNGNTHYNQKFKG

SEQ ID NO: 178 - protein, 11 aa, Artificial Sequence
  Description of Artificial Sequence: Synthetic peptide
  mC6-30[CLDN6] vhCDR3
IYYFGRLYFDF

SEQ ID NO: 179 - protein, 107 aa, Artificial Sequence
  Description of Artificial Sequence: Synthetic polypeptide
  mC6-30[CLDN6] Variable light (vl) domain
DIQMTQSSSSFSVSLGDRVTITCKASEDIYNRLAWYQQKPGNVPRLLISGATSLETGVPSRFSGSGSGKDYTLSITSLQTEDVTTYYCQQYWSSPLTFGGGTKLEIK

SEQ ID NO: 180 - protein, 11 aa, Artificial Sequence
  Description of Artificial Sequence: Synthetic peptide
  mC6-30[CLDN6] vlCDR1
KASEDIYNRLA

SEQ ID NO: 181 - protein, 7 aa, Artificial Sequence
  Description of Artificial Sequence: Synthetic peptide
  mC6-30[CLDN6] vlCDR2
GATSLET

SEQ ID NO: 182 - protein, 9 aa, Artificial Sequence
  Description of Artificial Sequence: Synthetic peptide
  mC6-30[CLDN6] vlCDR3
QQYWSSPLT

SEQ ID NO: 183 - protein, 449 aa, Artificial Sequence
  Description of Artificial Sequence: Synthetic polypeptide
  XENP34243 mC6-30 Heavy Chain
EVQLVQSGAEVKKPGESLRISCKTSGYTFTEYTMHWVRQMPGKSLEWMGGIDSNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - protein, 214 aa, Artificial Sequence
  Description of Artificial Sequence: Synthetic polypeptide
  XENP34243 mC6-30 Light Chain
DIQMTQSPSSLSASVGDRVTITCQASEDIYNRLAWYQQKPGKVPKLLISGATSLETGVPSRFSGSGSGKDYTFTISSLQPEDIATYYCQQYWSGPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 185 - protein, 120 aa, Artificial Sequence
  Description of Artificial Sequence: Synthetic polypeptide
  C6-30[CLDN6]_H1 Variable heavy (vh) domain
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYFGRLYFDFWGAGTLVTVSS

SEQ ID NO: 186 - protein, 5 aa, Artificial Sequence
  Description of Artificial Sequence: Synthetic peptide
  C6-30[CLDN6]_H1 vhCDR1
EYTMH

SEQ ID NO: 187 - protein, 17 aa, Artificial Sequence
  Description of Artificial Sequence: Synthetic peptide
  C6-30[CLDN6]_H1 vhCDR2
GIDPNNGNTHYNQKFQG

SEQ ID NO: 188 - protein, 11 aa, Artificial Sequence
  Description of Artificial Sequence: Synthetic peptide
  C6-30[CLDN6]_H1 vhCDR3
IYYFGRLYFDF

SEQ ID NO: 189 - protein, 120 aa, Artificial Sequence
  Description of Artificial Sequence: Synthetic polypeptide
  C6-30[CLDN6]_H2 Variable heavy (vh) domain
EVQLVQSGAEVKKPGESLRISCKTSGYTFTEYTMHWVRQMPGKSLEWMGGIDPNNGNTHYNQKFQGHVTISVDKSISTAYLQWSSLKASDTAMYYCARIYYFGRLYFDFWGAGTLVTVSS

SEQ ID NO: 190 - protein, 5 aa, Artificial Sequence
  Description of Artificial Sequence: Synthetic peptide
  C6-30[CLDN6]_H2 vhCDR1
EYTMH

SEQ ID NO: 191 - protein, 17 aa, Artificial Sequence
  Description of Artificial Sequence: Synthetic peptide
  C6-30[CLDN6]_H2 vhCDR2
GIDPNNGNTHYNQKFQG

SEQ ID NO: 192 - protein, 11 aa, Artificial Sequence
  Description of Artificial Sequence: Synthetic peptide
  C6-30[CLDN6]_H2 vhCDR3
IYYFGRLYFDF

SEQ ID NO: 193 - protein, 107 aa, Artificial Sequence
  Description of Artificial Sequence: Synthetic polypeptide
  C6-30[CLDN6]_L1 Variable light (vl) domain
DIQMTQSPSSLSASVGDRVTITCQASEDIYNRLAWYQQKPGKVPKLLISGATSLETGVPSRFSGSGSGKDYTFTISSLQPEDIATYYCQQYWSSPLTFGGGTKVEIK

SEQ ID NO: 194 - protein, 11 aa, Artificial Sequence
  Description of Artificial Sequence: Synthetic peptide
  C6-30[CLDN6]_L1 vlCDR1
QASEDIYNRLA

SEQ ID NO: 195 - protein, 7 aa, Artificial Sequence
  Description of Artificial Sequence: Synthetic peptide
  C6-30[CLDN6]_L1 vlCDR2
GATSLET

SEQ ID NO: 196 - protein, 9 aa, Artificial Sequence
  Description of Artificial Sequence: Synthetic peptide
  C6-30[CLDN6]_L1 vlCDR3
QQYWSSPLT

SEQ ID NO: 197 - protein, 107 aa, Artificial Sequence
  Description of Artificial Sequence: Synthetic polypeptide
  C6-30[CLDN6]_L2 Variable light (vl) domain
DIQMTQSPDSLAVSLGERATINCKASEDIYNRLAWYQQKPGQVPKLLISGATSLETGVPSRFSGSGSGKDYTLTISSLQAEDVAVYYCQQYWSSPLTFGGGTKVEIK

SEQ ID NO: 198 - protein, 11 aa, Artificial Sequence
  Description of Artificial Sequence: Synthetic peptide
  C6-30[CLDN6]_L2 vlCDR1
KASEDIYNRLA

SEQ ID NO: 199 - protein, 7 aa, Artificial Sequence
  Description of Artificial Sequence: Synthetic peptide
  C6-30[CLDN6]_L2 vlCDR2
GATSLET

SEQ ID NO: 200 - protein, 9 aa, Artificial Sequence
  Description of Artificial Sequence: Synthetic peptide
  C6-30[CLDN6]_L2 vlCDR3
QQYWSSPLT

SEQ ID NO: 201 - protein, 120 aa, Artificial Sequence
  Description of Artificial Sequence: Synthetic polypeptide
  C6-30[CLDN6]_H1.1 Variable heavy (vh) domain
QVQLVQSGAEVKKPGASVKVSCKTSGYTFTEYTMHWVRQAPGQSLEWMGGISPNNGNTHYNQKFQGRVTITVDKSASTAYMELSSLRSEDTAVYYCARIYYFGRLYFDFWGAGTLVTVSS

SEQ ID NO: 202 - protein, 5 aa, Artificial Sequence
  Description of Artificial Sequence: Synthetic peptide
  C6-30[CLDN6]_H1.1 vhCDR1
EYTMH

SEQ ID NO: 203 - protein, 17 aa, Artificial Sequence
  Description of Artificial Sequence: Synthetic peptide
  C6-30[CLDN6]_H1.1 vhCDR2
GISPNNGNTHYNQKFQG

SEQ ID NO: 204 - protein, 11 aa, Artificial Sequence
  Description of Artificial Sequence: Synthetic peptide
  C6-30[CLDN6]_H1.1 vhCDR3
IYYFGRLYFDF

SEQ ID NO: 205 - protein, 120 aa, Artificial Sequence
  Description of Artificial Sequence: Synthetic polypeptide
  C6-30[CLDN6]_H1.2 Variable heavy (vh) domain
QVQLVQSGAEVKKPGASVKVSCKTSGYTFTEYTMHWVRQAPGQSLEWMGGINPNNGNTHYNQKFQGRVTITVDKSASTAYMELSSLRSEDTAVYYCARIYYFGRLYFDFWGAGTLVTVSS

SEQ ID NO: 206 - protein, 5 aa, Artificial Sequence
  Description of Artificial Sequence: Synthetic peptide
  C6-30[CLDN6]_H1.2 vhCDR1
EYTMH

SEQ ID NO: 207 - protein, 17 aa, Artificial Sequence
  Description of Artificial Sequence: Synthetic peptide
  C6-30[CLDN6]_H1.2 vhCDR2
GINPNNGNTHYNQKFQG

SEQ ID NO: 208 - protein, 11 aa, Artificial Sequence
  Description of Artificial Sequence: Synthetic peptide
  C6-30[CLDN6]_H1.2 vhCDR3
IYYFGRLYFDF

SEQ ID NO: 209 - protein, 120 aa, Artificial Sequence
  Description of Artificial Sequence: Synthetic polypeptide
  C6-30[CLDN6]_H1.3 Variable heavy (vh) domain
QVQLVQSGAEVKKPGASVKVSCKTSGYTFTEYTMHWVRQAPGQSLEWMGGIDSNNGNTHYNQKFQGRVTITVDKSASTAYMELSSLRSEDTAVYYCARIYYFGRLYFDFWGAGTLVTVSS

SEQ ID NO: 210 - protein, 5 aa, Artificial Sequence
  Description of Artificial Sequence: Synthetic peptide
  C6-30[CLDN6]_H1.3 vhCDR1
EYTMH

SEQ ID NO: 211 - protein, 17 aa, Artificial Sequence
  Description of Artificial Sequence: Synthetic peptide
  C6-30[CLDN6]_H1.3 vhCDR2
GIDSNNGNTHYNQKFQG

SEQ ID NO: 212 - protein, 11 aa, Artificial Sequence
  Description of Artificial Sequence: Synthetic peptide
  C6-30[CLDN6]_H1.3 vhCDR3
IYYFGRLYFDF

SEQ ID NO: 213 - protein, 120 aa, Artificial Sequence
  Description of Artificial Sequence: Synthetic polypeptide
  C6-30[CLDN6]_H1.4 Variable heavy (vh) domain
QVQLVQSGAEVKKPGASVKVSCKTSGYTFTEYTMHWVRQAPGQSLEWMGGIDANNGNTHYNQKFQGRVTITVDKSASTAYMELSSLRSEDTAVYYCARIYYFGRLYFDFWGAGTLVTVSS

SEQ ID NO: 214 - protein, 5 aa, Artificial Sequence
  Description of Artificial Sequence: Synthetic peptide
  C6-30[CLDN6]_H1.4 vhCDR1
EYTMH

SEQ ID NO: 215 - protein, 17 aa, Artificial Sequence
  Description of Artificial Sequence: Synthetic peptide
  C6-30[CLDN6]_H1.4 vhCDR2
GIDANNGNTHYNQKFQG

SEQ ID NO: 216 - protein, 11 aa, Artificial Sequence
  Description of Artificial Sequence: Synthetic peptide
  C6-30[CLDN6]_H1.4 vhCDR3
IYYFGRLYFDF

SEQ ID NO: 217 - protein, 120 aa, Artificial Sequence
  Description of Artificial Sequence: Synthetic polypeptide
  C6-30[CLDN6]_H1.5 Variable heavy (vh) domain
QVQLVQSGAEVKKPGASVKVSCKTSGYTFTEYTMHWVRQAPGQSLEWMGGIDPQNGNTHYNQKFQGRVTITVDKSASTAYMELSSLRSEDTAVYYCARIYYFGRLYFDFWGAGTLVTVSS

SEQ ID NO: 218 - protein, 5 aa, Artificial Sequence
  Description of Artificial Sequence: Synthetic peptide
  C6-30[CLDN6]_H1.5 vhCDR1
EYTMH

SEQ ID NO: 219 - protein, 17 aa, Artificial Sequence
  Description of Artificial Sequence: Synthetic peptide
  C6-30[CLDN6]_H1.5 vhCDR2
GIDPQNGNTHYNQKFQG

SEQ ID NO: 220 - protein, 11 aa, Artificial Sequence
  Description of Artificial Sequence: Synthetic peptide
  C6-30[CLDN6]_H1.5 vhCDR3
IYYFGRLYFDF

SEQ ID NO: 221 - protein, 120 aa, Artificial Sequence
  Description of Artificial Sequence: Synthetic polypeptide
  C6-30[CLDN6]_H1.6 Variable heavy (vh) domain
QVQLVQSGAEVKKPGASVKVSCKTSGYTFTEYTMHWVRQAPGQSLEWMGGIDPNSGNTHYNQKFQGRVTITVDKSASTAYMELSSLRSEDTAVYYCARIYYFGRLYFDFWGAGTLVTVSS

SEQ ID NO: 222 - protein, 5 aa, Artificial Sequence
  Description of Artificial Sequence: Synthetic peptide
  C6-30[CLDN6]_H1.6 vhCDR1
EYTMH

SEQ ID NO: 223 - protein, 17 aa, Artificial Sequence
  Description of Artificial Sequence: Synthetic peptide
  C6-30[CLDN6]_H1.6 vhCDR2
GIDPNSGNTHYNQKFQG

SEQ ID NO: 224 - protein, 11 aa, Artificial Sequence
  Description of Artificial Sequence: Synthetic peptide
  C6-30[CLDN6]_H1.6 vhCDR3
IYYFGRLYFDF

SEQ ID NO: 225 - protein, 120 aa, Artificial Sequence
  Description of Artificial Sequence: Synthetic polypeptide
  C6-30[CLDN6]_H1.7 Variable heavy (vh) domain
QVQLVQSGAEVKKPGASVKVSCKTSGYTFTEYTMHWVRQAPGQSLEWMGGIDPNQGNTHYNQKFQGRVTITVDKSASTAYMELSSLRSEDTAVYYCARIYYFGRLYFDFWGAGTLVTVSS

SEQ ID NO: 226 - protein, 5 aa, Artificial Sequence
  Description of Artificial Sequence: Synthetic peptide
  C6-30[CLDN6]_H1.7 vhCDR1
EYTMH

SEQ ID NO: 227 - protein, 17 aa, Artificial Sequence
  Description of Artificial Sequence: Synthetic peptide
  C6-30[CLDN6]_H1.7 vhCDR2
GIDPNQGNTHYNQKFQG

SEQ ID NO: 228 - protein, 11 aa, Artificial Sequence
  Description of Artificial Sequence: Synthetic peptide
  C6-30[CLDN6]_H1.7 vhCDR3
IYYFGRLYFDF

SEQ ID NO: 229 - protein, 120 aa, Artificial Sequence
  Description of Artificial Sequence: Synthetic polypeptide
  C6-30[CLDN6]_H1.8 Variable heavy (vh) domain
QVQLVQSGAEVKKPGASVKVSCKTSGYTFTEYTMHWVRQAPGQSLEWMGGIDPNNDNTHYNQKFQGRVTITVDKSASTAYMELSSLRSEDTAVYYCARIYYFGRLYFDFWGAGTLVTVSS

SEQ ID NO: 230 - protein, 5 aa, Artificial Sequence
  Description of Artificial Sequence: Synthetic peptide
  C6-30[CLDN6]_H1.8 vhCDR1
EYTMH

SEQ ID NO: 231 - protein, 17 aa, Artificial Sequence
  Description of Artificial Sequence: Synthetic peptide
  C6-30[CLDN6]_H1.8 vhCDR2
GIDPNNDNTHYNQKFQG

SEQ ID NO: 232 - protein, 11 aa, Artificial Sequence
  Description of Artificial Sequence: Synthetic peptide
  C6-30[CLDN6]_H1.8 vhCDR3
IYYFGRLYFDF

SEQ ID NO: 233 - protein, 120 aa, Artificial Sequence
  Description of Artificial Sequence: Synthetic polypeptide
  C6-30[CLDN6]_H1.9 Variable heavy (vh) domain
QVQLVQSGAEVKKPGASVKVSCKTSGYTFTEYTMHWVRQAPGQSLEWMGGIDPNNANTHYNQKFQGRVTITVDKSASTAYMELSSLRSEDTAVYYCARIYYFGRLYFDFWGAGTLVTVSS

SEQ ID NO: 234 - protein, 5 aa, Artificial Sequence
  Description of Artificial Sequence: Synthetic peptide
  C6-30[CLDN6]_H1.9 vhCDR1
EYTMH

SEQ ID NO: 235 - protein, 17 aa, Artificial Sequence
  Description of Artificial Sequence: Synthetic peptide
  C6-30[CLDN6]_H1.9 vhCDR2
GIDPNNANTHYNQKFQG

SEQ ID NO: 236 - protein, 11 aa, Artificial Sequence
  Description of Artificial Sequence: Synthetic peptide
  C6-30[CLDN6]_H1.9 vhCDR3
IYYFGRLYFDF

SEQ ID NO: 237 - protein, 120 aa, Artificial Sequence
  Description of Artificial Sequence: Synthetic polypeptide
  C6-30[CLDN6]_H1.19 Variable heavy (vh) domain
QVQLVQSGAEVKKPGASVKVSCKTSGYTFTEYTMHWVRQAPGQSLEWMGGIDPNNGNTHYNQKFQGRVTITVDKSASTAYMELSSLRSEDTATYYCARIYYFGRLYFDFWGAGTLVTVSS

SEQ ID NO: 238 - protein, 5 aa, Artificial Sequence
  Description of Artificial Sequence: Synthetic peptide
  C6-30[CLDN6]_H1.19 vhCDR1
EYTMH

SEQ ID NO: 239 - protein, 17 aa, Artificial Sequence
  Description of Artificial Sequence: Synthetic peptide
  C6-30[CLDN6]_H1.19 vhCDR2
GIDPNNGNTHYNQKFQG

SEQ ID NO: 240 - protein, 11 aa, Artificial Sequence
  Description of Artificial Sequence: Synthetic peptide
  C6-30[CLDN6]_H1.19 vhCDR3
IYYFGRLYFDF

SEQ ID NO: 241 - protein, 120 aa, Artificial Sequence
  Description of Artificial Sequence: Synthetic polypeptide
  C6-30[CLDN6]_H1.22 Variable heavy (vh) domain
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARILYFGRLYFDFWGAGTLVTVSS

SEQ ID NO: 242 - protein, 5 aa, Artificial Sequence
  Description of Artificial Sequence: Synthetic peptide
  C6-30[CLDN6]_H1.22 vhCDR1
EYTMH

SEQ ID NO: 243 - protein, 17 aa, Artificial Sequence
  Description of Artificial Sequence: Synthetic peptide
  C6-30[CLDN6]_H1.22 vhCDR2
GIDPNNGNTHYNQKFQG

SEQ ID NO: 244 - protein, 11 aa, Artificial Sequence
  Description of Artificial Sequence: Synthetic peptide
  C6-30[CLDN6]_H1.22 vhCDR3
ILYFGRLYFDF

SEQ ID NO: 245 - protein, 120 aa, Artificial Sequence
  Description of Artificial Sequence: Synthetic polypeptide
  C6-30[CLDN6]_H1.24 Variable heavy (vh) domain
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYLGRLYFDFWGAGTLVTVSS

SEQ ID NO: 246 - protein, 5 aa, Artificial Sequence
  Description of Artificial Sequence: Synthetic peptide
  C6-30[CLDN6]_H1.24 vhCDR1
EYTMH

SEQ ID NO: 247 - protein, 17 aa, Artificial Sequence
  Description of Artificial Sequence: Synthetic peptide
  C6-30[CLDN6]_H1.24 vhCDR2
GIDPNNGNTHYNQKFQG

SEQ ID NO: 248 - protein, 11 aa, Artificial Sequence
  Description of Artificial Sequence: Synthetic peptide
  C6-30[CLDN6]_H1.24 vhCDR3
IYYLGRLYFDF

SEQ ID NO: 249 - protein, 120 aa, Artificial Sequence
  Description of Artificial Sequence: Synthetic polypeptide
  C6-30[CLDN6]_H2.1 Variable heavy (vh) domain
EVQLVQSGAEVKKPGESLRISCKTSGYTFTEYTMHWVRQMPGKSLEWMGGISPNNGNTHYNQKFQGHVTISVDKSISTAYLQWSSLKASDTAMYYCARIYYFGRLYFDFWGAGTLVTVSS

SEQ ID NO: 250 - protein, 5 aa, Artificial Sequence
  Description of Artificial Sequence: Synthetic peptide
  C6-30[CLDN6]_H2.1 vhCDR1
EYTMH

SEQ ID NO: 251 - protein, 17 aa, Artificial Sequence
  Description of Artificial Sequence: Synthetic peptide
  C6-30[CLDN6]_H2.1 vhCDR2
GISPNNGNTHYNQKFQG

SEQ ID NO: 252 - protein, 11 aa, Artificial Sequence
  Description of Artificial Sequence: Synthetic peptide
  C6-30[CLDN6]_H2.1 vhCDR3
IYYFGRLYFDF

SEQ ID NO: 253 - protein, 120 aa, Artificial Sequence
  Description of Artificial Sequence: Synthetic polypeptide
  C6-30[CLDN6]_H2.2 Variable heavy (vh) domain
EVQLVQSGAEVKKPGESLRISCKTSGYTFTEYTMHWVRQMPGKSLEWMGGITPNNGNTHYNQKFQGHVTISVDKSISTAYLQWSSLKASDTAMYYCARIYYFGRLYFDFWGAGTLVTVSS

SEQ ID NO: 254 - protein, 5 aa, Artificial Sequence
  Description of Artificial Sequence: Synthetic peptide
  C6-30[CLDN6]_H2.2 vhCDR1
EYTMH

SEQ ID NO: 255 - protein, 17 aa, Artificial Sequence
  Description of Artificial Sequence: Synthetic peptide
  C6-30[CLDN6]_H2.2 vhCDR2
GITPNNGNTHYNQKFQG

SEQ ID NO: 256 - protein, 11 aa, Artificial Sequence
  Description of Artificial Sequence: Synthetic peptide
  C6-30[CLDN6]_H2.2 vhCDR3
IYYFGRLYFDF

SEQ ID NO: 257 - protein, 120 aa, Artificial Sequence
  Description of Artificial Sequence: Synthetic polypeptide
  C6-30[CLDN6]_H2.3 Variable heavy (vh) domain
EVQLVQSGAEVKKPGESLRISCKTSGYTFTEYTMHWVRQMPGKSLEWMGGIDSNNGNTHYNQKFQGHVTISVDKSISTAYLQWSSLKASDTAMYYCARIYYFGRLYFDFWGAGTLVTVSS

SEQ ID NO: 258 - protein, 5 aa, Artificial Sequence
  Description of Artificial Sequence: Synthetic peptide
  C6-30[CLDN6]_H2.3 vhCDR1
EYTMH

SEQ ID NO: 259 - protein, 17 aa, Artificial Sequence
  Description of Artificial Sequence: Synthetic peptide
  C6-30[CLDN6]_H2.3 vhCDR2
GIDSNNGNTHYNQKFQG

SEQ ID NO: 260 - protein, 11 aa, Artificial Sequence
  Description of Artificial Sequence: Synthetic peptide
  C6-30[CLDN6]_H2.3 vhCDR3
IYYFGRLYFDF

SEQ ID NO: 261 - protein, 120 aa, Artificial Sequence
  Description of Artificial Sequence: Synthetic polypeptide
  C6-30[CLDN6]_H2.4 Variable heavy (vh) domain
EVQLVQSGAEVKKPGESLRISCKTSGYTFTEYTMHWVRQMPGKSLEWMGGIDGNNGNTHYNQKFQGHVTISVDKSISTAYLQWSSLKASDTAMYYCARIYYFGRLYFDFWGAGTLVTVSS

SEQ ID NO: 262 - protein, 5 aa, Artificial Sequence
  Description of Artificial Sequence: Synthetic peptide
  C6-30[CLDN6]_H2.4 vhCDR1
EYTMH

SEQ ID NO: 263 - protein, 17 aa, Artificial Sequence
  Description of Artificial Sequence: Synthetic peptide
  C6-30[CLDN6]_H2.4 vhCDR2
GIDGNNGNTHYNQKFQG

SEQ ID NO: 264 - protein, 11 aa, Artificial Sequence
  Description of Artificial Sequence: Synthetic peptide
  C6-30[CLDN6]_H2.4 vhCDR3
IYYFGRLYFDF

SEQ ID NO: 265 - protein, 120 aa, Artificial Sequence
  Description of Artificial Sequence: Synthetic polypeptide
  C6-30[CLDN6]_H2.5 Variable heavy (vh) domain
EVQLVQSGAEVKKPGESLRISCKTSGYTFTEYTMHWVRQMPGKSLEWMGGIDPQNGNTHYNQKFQGHVTISVDKSISTAYLQWSSLKASDTAMYYCARIYYFGRLYFDFWGAGTLVTVSS

SEQ ID NO: 266 - protein, 5 aa, Artificial Sequence
  Description of Artificial Sequence: Synthetic peptide
  C6-30[CLDN6]_H2.5 vhCDR1
EYTMH

SEQ ID NO: 267 - protein, 17 aa, Artificial Sequence
  Description of Artificial Sequence: Synthetic peptide
  C6-30[CLDN6]_H2.5 vhCDR2
GIDPQNGNTHYNQKFQG

SEQ ID NO: 268 - protein, 11 aa, Artificial Sequence
  Description of Artificial Sequence: Synthetic peptide
  C6-30[CLDN6]_H2.5 vhCDR3
IYYFGRLYFDF

SEQ ID NO: 269 - protein, 120 aa, Artificial Sequence
  Description of Artificial Sequence: Synthetic polypeptide
  C6-30[CLDN6]_H2.6 Variable heavy (vh) domain
EVQLVQSGAEVKKPGESLRISCKTSGYTFTEYTMHWVRQMPGKSLEWMGGIDPNDGNTHYNQKFQGHVTISVDKSISTAYLQWSSLKASDTAMYYCARIYYFGRLYFDFWGAGTLVTVSS

SEQ ID NO: 270 - protein, 5 aa, Artificial Sequence
  Description of Artificial Sequence: Synthetic peptide
  C6-30[CLDN6]_H2.6 vhCDR1
EYTMH

SEQ ID NO: 271 - protein, 17 aa, Artificial Sequence
  Description of Artificial Sequence: Synthetic peptide
  C6-30[CLDN6]_H2.6 vhCDR2
GIDPNDGNTHYNQKFQG

SEQ ID NO: 272 - protein, 11 aa, Artificial Sequence
  Description of Artificial Sequence: Synthetic peptide
  C6-30[CLDN6]_H2.6 vhCDR3
IYYFGRLYFDF

SEQ ID NO: 273 - protein, 120 aa, Artificial Sequence
  Description of Artificial Sequence: Synthetic polypeptide
  C6-30[CLDN6]_H2.7 Variable heavy (vh) domain
EVQLVQSGAEVKKPGESLRISCKTSGYTFTEYTMHWVRQMPGKSLEWMGGIDPNQGNTHYNQKFQGHVTISVDKSISTAYLQWSSLKASDTAMYYCARIYYFGRLYFDFWGAGTLVTVSS

SEQ ID NO: 274 - protein, 5 aa, Artificial Sequence
  Description of Artificial Sequence: Synthetic peptide
  C6-30[CLDN6]_H2.7 vhCDR1
EYTMH

SEQ ID NO: 275 - protein, 17 aa, Artificial Sequence
  Description of Artificial Sequence: Synthetic peptide
  C6-30[CLDN6]_H2.7 vhCDR2
GIDPNQGNTHYNQKFQG

SEQ ID NO: 276 - protein, 11 aa, Artificial Sequence
  Description of Artificial Sequence: Synthetic peptide
  C6-30[CLDN6]_H2.7 vhCDR3
IYYFGRLYFDF

SEQ ID NO: 277 - protein, 120 aa, Artificial Sequence
  Description of Artificial Sequence: Synthetic polypeptide
  C6-30[CLDN6]_H2.8 Variable heavy (vh) domain
EVQLVQSGAEVKKPGESLRISCKTSGYTFTEYTMHWVRQMPGKSLEWMGGIDPNNDNTHYNQKFQGHVTISVDKSISTAYLQWSSLKASDTAMYYCARIYYFGRLYFDFWGAGTLVTVSS

SEQ ID NO: 278 - protein, 5 aa, Artificial Sequence
  Description of Artificial Sequence: Synthetic peptide
  C6-30[CLDN6]_H2.8 vhCDR1
EYTMH

SEQ ID NO: 279 - protein, 17 aa, Artificial Sequence
  Description of Artificial Sequence: Synthetic peptide
  C6-30[CLDN6]_H2.8 vhCDR2
GIDPNNDNTHYNQKFQG

SEQ ID NO: 280 - protein, 11 aa, Artificial Sequence
  Description of Artificial Sequence: Synthetic peptide
  C6-30[CLDN6]_H2.8 vhCDR3
IYYFGRLYFDF

SEQ ID NO: 281 - protein, 120 aa, Artificial Sequence
  Description of Artificial Sequence: Synthetic polypeptide
  C6-30[CLDN6]_H2.9 Variable heavy (vh) domain
EVQLVQSGAEVKKPGESLRISCKTSGYTFTEYTMHWVRQMPGKSLEWMGGIDPNNANTHYNQKFQGHVTISVDKSISTAYLQWSSLKASDTAMYYCARIYYFGRLYFDFWGAGTLVTVSS

SEQ ID NO: 282 - protein, 5 aa, Artificial Sequence
  Description of Artificial Sequence: Synthetic peptide
  C6-30[CLDN6]_H2.9 vhCDR1
EYTMH

SEQ ID NO: 283 - protein, 17 aa, Artificial Sequence
  Description of Artificial Sequence: Synthetic peptide
  C6-30[CLDN6]_H2.9 vhCDR2
GIDPNNANTHYNQKFQG

SEQ ID NO: 284 - protein, 11 aa, Artificial Sequence
  Description of Artificial Sequence: Synthetic peptide
  C6-30[CLDN6]_H2.9 vhCDR3
IYYFGRLYFDF

SEQ ID NO: 285 - protein, 120 aa, Artificial Sequence
  Description of Artificial Sequence: Synthetic polypeptide
  C6-30[CLDN6]_H2.11 Variable heavy (vh) domain
EVQLVQSGAEVKKPGESLRISCKTSGYSFTEYTMHWVRQMPGKSLEWMGGIDPNNGNTHYNQKFQGHVTISVDKSISTAYLQWSSLKASDTAMYYCARIYYFGRLYFDFWGAGTLVTVSS

SEQ ID NO: 286 - protein, 5 aa, Artificial Sequence
  Description of Artificial Sequence: Synthetic peptide
  C6-30[CLDN6]_H2.11 vhCDR1
EYTMH

SEQ ID NO: 287 - protein, 17 aa, Artificial Sequence
  Description of Artificial Sequence: Synthetic peptide
  C6-30[CLDN6]_H2.11 vhCDR2
GIDPNNGNTHYNQKFQG

SEQ ID NO: 288 - protein, 11 aa, Artificial Sequence
  Description of Artificial Sequence: Synthetic peptide
  C6-30[CLDN6]_H2.11 vhCDR3
IYYFGRLYFDF

SEQ ID NO: 289 - protein, 120 aa, Artificial Sequence
  Description of Artificial Sequence: Synthetic polypeptide
  C6-30[CLDN6]_H2.12 Variable heavy (vh) domain
EVQLVQSGAEVKKPGESLRISCKTSGYDFTEYTMHWVRQMPGKSLEWMGGIDPNNGNTHYNQKFQGHVTISVDKSISTAYLQWSSLKASDTAMYYCARIYYFGRLYFDFWGAGTLVTVSS

SEQ ID NO: 290 - protein, 5 aa, Artificial Sequence
  Description of Artificial Sequence: Synthetic peptide
  C6-30[CLDN6]_H2.12 vhCDR1
EYTMH

SEQ ID NO: 291 - protein, 17 aa, Artificial Sequence
  Description of Artificial Sequence: Synthetic peptide
  C6-30[CLDN6]_H2.12 vhCDR2
GIDPNNGNTHYNQKFQG

SEQ ID NO: 292 - protein, 11 aa, Artificial Sequence
  Description of Artificial Sequence: Synthetic peptide
  C6-30[CLDN6]_H2.12 vhCDR3
IYYFGRLYFDF

SEQ ID NO: 293 - protein, 120 aa, Artificial Sequence
  Description of Artificial Sequence: Synthetic polypeptide
  C6-30[CLDN6]_H2.71 Variable heavy (vh) domain
EVQLVQSGAEVKKPGESLRISCKTSGYTFTEYTMHWVRQMPGKSLEWMGGIDLNNGNTHYNQKFQGHVTISVDKSISTAYLQWSSLKASDTAMYYCARIYYFGRLYFDFWGAGTLVTVSS

SEQ ID NO: 294 - protein, 5 aa, Artificial Sequence
  Description of Artificial Sequence: Synthetic peptide
  C6-30[CLDN6]_H2.71 vhCDR1
EYTMH

SEQ ID NO: 295 - protein, 17 aa, Artificial Sequence
  Description of Artificial Sequence: Synthetic peptide
  C6-30[CLDN6]_H2.71 vhCDR2
GIDLNNGNTHYNQKFQG

SEQ ID NO: 296 - protein, 11 aa, Artificial Sequence
  Description of Artificial Sequence: Synthetic peptide
  C6-30[CLDN6]_H2.71 vhCDR3
IYYFGRLYFDF

SEQ ID NO: 297 - protein, 120 aa, Artificial Sequence
  Description of Artificial Sequence: Synthetic polypeptide
  C6-30[CLDN6]_H2.75 Variable heavy (vh) domain
EVQLVQSGAEVKKPGESLRISCKTSGYTFTEYTMHWVRQMPGKSLEWMGGIDPHNGNTHYNQKFQGHVTISVDKSISTAYLQWSSLKASDTAMYYCARIYYFGRLYFDFWGAGTLVTVSS

SEQ ID NO: 298 - protein, 5 aa, Artificial Sequence
  Description of Artificial Sequence: Synthetic peptide
  C6-30[CLDN6]_H2.75 vhCDR1
EYTMH

SEQ ID NO: 299 - protein, 17 aa, Artificial Sequence
  Description of Artificial Sequence: Synthetic peptide
  C6-30[CLDN6]_H2.75 vhCDR2
GIDPHNGNTHYNQKFQG

SEQ ID NO: 300 - protein, 11 aa, Artificial Sequence
  Description of Artificial Sequence: Synthetic peptide
  C6-30[CLDN6]_H2.75 vhCDR3
IYYFGRLYFDF

SEQ ID NO: 301 - protein, 120 aa, Artificial Sequence
  Description of Artificial Sequence: Synthetic polypeptide
  C6-30[CLDN6]_H2.90 Variable heavy (vh) domain
EVQLVQSGAEVKKPGESLRISCKTSGYTFTEYTMHWVRQMPGKSLEWMGGIDPNNLNTHYNQKFQGHVTISVDKSISTAYLQWSSLKASDTAMYYCARIYYFGRLYFDFWGAGTLVTVSS

SEQ ID NO: 302 - protein, 5 aa, Artificial Sequence
  Description of Artificial Sequence: Synthetic peptide
  C6-30[CLDN6]_H2.90 vhCDR1
EYTMH

SEQ ID NO: 303 - protein, 17 aa, Artificial Sequence
  Description of Artificial Sequence: Synthetic peptide
  C6-30[CLDN6]_H2.90 vhCDR2
GIDPNNLNTHYNQKFQG

SEQ ID NO: 304 - protein, 11 aa, Artificial Sequence
  Description of Artificial Sequence: Synthetic peptide
  C6-30[CLDN6]_H2.90 vhCDR3
IYYFGRLYFDF

SEQ ID NO: 305 - protein, 120 aa, Artificial Sequence
  Description of Artificial Sequence: Synthetic polypeptide
  C6-30[CLDN6]_H2.91 Variable heavy (vh) domain
EVQLVQSGAEVKKPGESLRISCKTSGYTFTEYTMHWVRQMPGKSLEWMGGIDPNNFNTHYNQKFQGHVTISVDKSISTAYLQWSSLKASDTAMYYCARIYYFGRLYFDFWGAGTLVTVSS

SEQ ID NO: 306 - protein, 5 aa, Artificial Sequence
  Description of Artificial Sequence: Synthetic peptide
  C6-30[CLDN6]_H2.91 vhCDR1
EYTMH

SEQ ID NO: 307 - protein, 17 aa, Artificial Sequence
  Description of Artificial Sequence: Synthetic peptide
  C6-30[CLDN6]_H2.91 vhCDR2
GIDPNNFNTHYNQKFQG

SEQ ID NO: 308 - protein, 11 aa, Artificial Sequence
  Description of Artificial Sequence: Synthetic peptide
  C6-30[CLDN6]_H2.91 vhCDR3
IYYFGRLYFDF

SEQ ID NO: 309 - protein, 120 aa, Artificial Sequence
  Description of Artificial Sequence: Synthetic polypeptide
  C6-30[CLDN6]_H2.118 Variable heavy (vh) domain
EVQLVQSGAEVKKPGESLRISCKTSGYTFTEYTMHWVRQMPGKSLEWMGGIDPNNGNTHYNQKKQGHVTISVDKSISTAYLQWSSLKASDTAMYYCARIYYFGRLYFDFWGAGTLVTVSS

SEQ ID NO: 310 - protein, 5 aa, Artificial Sequence
  Description of Artificial Sequence: Synthetic peptide
  C6-30[CLDN6]_H2.118 vhCDR1
EYTMH

SEQ ID NO: 311 - protein, 17 aa, Artificial Sequence
  Description of Artificial Sequence: Synthetic peptide
  C6-30[CLDN6]_H2.118 vhCDR2
GIDPNNGNTHYNQKKQG

SEQ ID NO: 312 - protein, 11 aa, Artificial Sequence
  Description of Artificial Sequence: Synthetic peptide
  C6-30[CLDN6]_H2.118 vhCDR3
IYYFGRLYFDF

SEQ ID NO: 313 - protein, 120 aa, Artificial Sequence
  Description of Artificial Sequence: Synthetic polypeptide
  C6-30[CLDN6]_H2.119 Variable heavy (vh) domain
EVQLVQSGAEVKKPGESLRISCKTSGYTFTEYTMHWVRQMPGKSLEWMGGIDPNNGNTHYNQKFEGHVTISVDKSISTAYLQWSSLKASDTAMYYCARIYYFGRLYFDFWGAGTLVTVSS

SEQ ID NO: 314 - protein, 5 aa, Artificial Sequence
  Description of Artificial Sequence: Synthetic peptide
  C6-30[CLDN6]_H2.119 vhCDR1
EYTMH

SEQ ID NO: 315 - protein, 17 aa, Artificial Sequence
  Description of Artificial Sequence: Synthetic peptide
  C6-30[CLDN6]_H2.119 vhCDR2
GIDPNNGNTHYNQKFEG

SEQ ID NO: 316 - protein, 11 aa, Artificial Sequence
  Description of Artificial Sequence: Synthetic peptide
  C6-30[CLDN6]_H2.119 vhCDR3
IYYFGRLYFDF

SEQ ID NO: 317 - protein, 107 aa, Artificial Sequence
  Description of Artificial Sequence: Synthetic polypeptide
  C6-30[CLDN6]_L1.1 Variable light (vl) domain
DIQMTQSPSSLSASVGDRVTITCQASQDIYNRLAWYQQKPGKVPKLLISGATSLETGVPSRFSGSGSGKDYTFTISSLQPEDIATYYCQQYWSSPLTFGGGTKVEIK

SEQ ID NO: 318 - protein, 11 aa, Artificial Sequence
  Description of Artificial Sequence: Synthetic peptide
  C6-30[CLDN6]_L1.1 vlCDR1
QASQDIYNRLA

SEQ ID NO: 319 - protein, 7 aa, Artificial Sequence
  Description of Artificial Sequence: Synthetic peptide
  C6-30[CLDN6]_L1.1 vlCDR2
GATSLET

SEQ ID NO: 320 - protein, 9 aa, Artificial Sequence
  Description of Artificial Sequence: Synthetic peptide
  C6-30[CLDN6]_L1.1 vlCDR3
QQYWSSPLT

SEQ ID NO: 321 - protein, 107 aa, Artificial Sequence
  Description of Artificial Sequence: Synthetic polypeptide
  C6-30[CLDN6]_L1.4 Variable light (vl) domain
DIQMTQSPSSLSASVGDRVTITCQASEDVYNRLAWYQQKPGKVPKLLISGATSLETGVPSRFSGSGSGKDYTFTISSLQPEDIATYYCQQYWSSPLTFGGGTKVEIK

SEQ ID NO: 322 - protein, 11 aa, Artificial Sequence
  Description of Artificial Sequence: Synthetic peptide
  C6-30[CLDN6]_L1.4 vlCDR1
QASEDVYNRLA

SEQ ID NO: 323 - protein, 7 aa, Artificial Sequence
  Description of Artificial Sequence: Synthetic peptide
  C6-30[CLDN6]_L1.4 vlCDR2
GATSLET

SEQ ID NO: 324 - protein, 9 aa, Artificial Sequence
  Description of Artificial Sequence: Synthetic peptide
  C6-30[CLDN6]_L1.4 vlCDR3
QQYWSSPLT

SEQ ID NO: 325 - protein, 107 aa, Artificial Sequence
  Description of Artificial Sequence: Synthetic polypeptide
  C6-30[CLDN6]_L1.7 Variable light (vl) domain
DIQMTQSPSSLSASVGDRVTITCQASEDIYSRLAWYQQKPGKVPKLLISGATSLETGVPSRFSGSGSGKDYTFTISSLQPEDIATYYCQQYWSSPLTFGGGTKVEIK

SEQ ID NO: 326 - protein, 11 aa, Artificial Sequence
  Description of Artificial Sequence: Synthetic peptide
  C6-30[CLDN6]_L1.7 vlCDR1
QASEDIYSRLA

SEQ ID NO: 327 - protein, 7 aa, Artificial Sequence
  Description of Artificial Sequence: Synthetic peptide
  C6-30[CLDN6]_L1.7 vlCDR2
GATSLET

SEQ ID NO: 328 - protein, 9 aa, Artificial Sequence
  Description of Artificial Sequence: Synthetic peptide
  C6-30[CLDN6]_L1.7 vlCDR3
QQYWSSPLT

SEQ ID NO: 329 - protein, 107 aa, Artificial Sequence
  Description of Artificial Sequence: Synthetic polypeptide
  C6-30[CLDN6]_L1.16 Variable light (vl) domain
DIQMTQSPSSLSASVGDRVTITCQASEDIYNRLAWYQQKPGKVPKLLISAATSLETGVPSRFSGSGSGKDYTFTISSLQPEDIATYYCQQYWSSPLTFGGGTKVEIK

SEQ ID NO: 330 - protein, 11 aa, Artificial Sequence
  Description of Artificial Sequence: Synthetic peptide
  C6-30[CLDN6]_L1.16 vlCDR1
QASEDIYNRLA

SEQ ID NO: 331 - protein, 7 aa, Artificial Sequence
  Description of Artificial Sequence: Synthetic peptide
  C6-30[CLDN6]_L1.16 vlCDR2
AATSLET

SEQ ID NO: 332 - protein, 9 aa, Artificial Sequence
  Description of Artificial Sequence: Synthetic peptide
  C6-30[CLDN6]_L1.16 vlCDR3
QQYWSSPLT

SEQ ID NO: 333 - protein, 107 aa, Artificial Sequence
  Description of Artificial Sequence: Synthetic polypeptide
  C6-30[CLDN6]_L1.18 Variable light (vl) domain
DIQMTQSPSSLSASVGDRVTITCQASEDIYNRLAWYQQKPGKVPKLLISGTTSLETGVPSRFSGSGSGKDYTFTISSLQPEDIATYYCQQYWSSPLTFGGGTKVEIK

SEQ ID NO: 334 - protein, 11 aa, Artificial Sequence
  Description of Artificial Sequence: Synthetic peptide
  C6-30[CLDN6]_L1.18 vlCDR1
QASEDIYNRLA

SEQ ID NO: 335 - protein, 7 aa, Artificial Sequence
  Description of Artificial Sequence: Synthetic peptide
  C6-30[CLDN6]_L1.18 vlCDR2
GTTSLET

SEQ ID NO: 336 - protein, 9 aa, Artificial Sequence
  Description of Artificial Sequence: Synthetic peptide
  C6-30[CLDN6]_L1.18 vlCDR3
QQYWSSPLT

SEQ ID NO: 337 - protein, 107 aa, Artificial Sequence
  Description of Artificial Sequence: Synthetic polypeptide
  C6-30[CLDN6]_L1.19 Variable light (vl) domain
DIQMTQSPSSLSASVGDRVTITCQASEDIYNRLAWYQQKPGKVPKLLISGASSLETGVPSRFSGSGSGKDYTFTISSLQPEDIATYYCQQYWSSPLTFGGGTKVEIK

SEQ ID NO: 338 - protein, 11 aa, Artificial Sequence
  Description of Artificial Sequence: Synthetic peptide
  C6-30[CLDN6]_L1.19 vlCDR1
QASEDIYNRLA

SEQ ID NO: 339 - protein, 7 aa, Artificial Sequence
  Description of Artificial Sequence: Synthetic peptide
  C6-30[CLDN6]_L1.19 vlCDR2
GASSLET

SEQ ID NO: 340 - protein, 9 aa, Artificial Sequence
  Description of Artificial Sequence: Synthetic peptide
  C6-30[CLDN6]_L1.19 vlCDR3
QQYWSSPLT

SEQ ID NO: 341 - protein, 107 aa, Artificial Sequence
  Description of Artificial Sequence: Synthetic polypeptide
  C6-30[CLDN6]_L1.21 Variable light (vl) domain
DIQMTQSPSSLSASVGDRVTITCQASEDIYNRLAWYQQKPGKVPKLLISGATNLETGVPSRFSGSGSGKDYTFTISSLQPEDIATYYCQQYWSSPLTFGGGTKVEIK

SEQ ID NO: 342 - protein, 11 aa, Artificial Sequence
  Description of Artificial Sequence: Synthetic peptide
  C6-30[CLDN6]_L1.21 vlCDR1
QASEDIYNRLA

SEQ ID NO: 343 - protein, 7 aa, Artificial Sequence
  Description of Artificial Sequence: Synthetic peptide
  C6-30[CLDN6]_L1.21 vlCDR2
GATNLET

SEQ ID NO: 344 - protein, 9 aa, Artificial Sequence
  Description of Artificial Sequence: Synthetic peptide
  C6-30[CLDN6]_L1.21 vlCDR3
QQYWSSPLT

SEQ ID NO: 345 - protein, 107 aa, Artificial Sequence
  Description of Artificial Sequence: Synthetic polypeptide
  C6-30[CLDN6]_L1.22 Variable light (vl) domain
DIQMTQSPSSLSASVGDRVTITCQASEDIYNRLAWYQQKPGKVPKLLISGATQLETGVPSRFSGSGSGKDYTFTISSLQPEDIATYYCQQYWSSPLTFGGGTKVEIK

SEQ ID NO: 346 - protein, 11 aa, Artificial Sequence
  Description of Artificial Sequence: Synthetic peptide
  C6-30[CLDN6]_L1.22 vlCDR1
QASEDIYNRLA

SEQ ID NO: 347 - protein, 7 aa, Artificial Sequence
  Description of Artificial Sequence: Synthetic peptide
  C6-30[CLDN6]_L1.22 vlCDR2
GATQLET

SEQ ID NO: 348 - protein, 9 aa, Artificial Sequence
  Description of Artificial Sequence: Synthetic peptide
  C6-30[CLDN6]_L1.22 vlCDR3
QQYWSSPLT

SEQ ID NO: 349 - protein, 107 aa, Artificial Sequence
  Description of Artificial Sequence: Synthetic polypeptide
  C6-30[CLDN6]_L1.23 Variable light (vl) domain
DIQMTQSPSSLSASVGDRVTITCQASEDIYNRLAWYQQKPGKVPKLLISGATSRETGVPSRFSGSGSGKDYTFTISSLQPEDIATYYCQQYWSSPLTFGGGTKVEIK

SEQ ID NO: 350 - protein, 11 aa, Artificial Sequence
  Description of Artificial Sequence: Synthetic peptide
  C6-30[CLDN6]_L1.23 vlCDR1
QASEDIYNRLA

SEQ ID NO: 351 - protein, 7 aa, Artificial Sequence
  Description of Artificial Sequence: Synthetic peptide
  C6-30[CLDN6]_L1.23 vlCDR2
GATSRET

SEQ ID NO: 352 - protein, 9 aa, Artificial Sequence
  Description of Artificial Sequence: Synthetic peptide
  C6-30[CLDN6]_L1.23 vlCDR3
QQYWSSPLT

SEQ ID NO: 353 - protein, 107 aa, Artificial Sequence
  Description of Artificial Sequence: Synthetic polypeptide
  C6-30[CLDN6]_L1.27 Variable light (vl) domain
DIQMTQSPSSLSASVGDRVTITCQASEDIYNRLAWYQQKPGKVPKLLISGATSLESGVPSRFSGSGSGKDYTFTISSLQPEDIATYYCQQYWSSPLTFGGGTKVEIK

SEQ ID NO: 354 - protein, 11 aa, Artificial Sequence
  Description of Artificial Sequence: Synthetic peptide
  C6-30[CLDN6]_L1.27 vlCDR1
QASEDIYNRLA

SEQ ID NO: 355 - protein, 7 aa, Artificial Sequence
  Description of Artificial Sequence: Synthetic peptide
  C6-30[CLDN6]_L1.27 vlCDR2
GATSLES

SEQ ID NO: 356 - protein, 9 aa, Artificial Sequence
  Description of Artificial Sequence: Synthetic peptide
  C6-30[CLDN6]_L1.27 vlCDR3
QQYWSSPLT

SEQ ID NO: 357 - protein, 107 aa, Artificial Sequence
  Description of Artificial Sequence: Synthetic polypeptide
  C6-30[CLDN6]_L1.60 Variable light (vl) domain
DIQMTQSPSSLSASVGDRVTITCQASEDIYNRLAWYQQKPGKVPKLLISGATSLETGVPSRFSGSGSGKDYTFTISSLQPEDIATYYCQQLWSSPLTFGGGTKVEIK

SEQ ID NO: 358 - protein, 11 aa, Artificial Sequence
  Description of Artificial Sequence: Synthetic peptide
  C6-30[CLDN6]_L1.60 vlCDR1
QASEDIYNRLA

SEQ ID NO: 359 - protein, 7 aa, Artificial Sequence
  Description of Artificial Sequence: Synthetic peptide
  C6-30[CLDN6]_L1.60 vlCDR2
GATSLET

SEQ ID NO: 360 - protein, 9 aa, Artificial Sequence
  Description of Artificial Sequence: Synthetic peptide
  C6-30[CLDN6]_L1.60 vlCDR3
QQLWSSPLT

SEQ ID NO: 361 - protein, 107 aa, Artificial Sequence
  Description of Artificial Sequence: Synthetic polypeptide
  C6-30[CLDN6]_L1.107 Variable light (vl) domain
DIQMTQSPSSLSASVGDRVTITCQASEDIVNRLAWYQQKPGKVPKLLISGATSLETGVPSRFSGSGSGKDYTFTISSLQPEDIATYYCQQYWSSPLTFGGGTKVEIK

SEQ ID NO: 362 - protein, 11 aa, Artificial Sequence
  Description of Artificial Sequence: Synthetic peptide
  C6-30[CLDN6]_L1.107 vlCDR1
QASEDIVNRLA

SEQ ID NO: 363 - protein, 7 aa, Artificial Sequence
  Description of Artificial Sequence: Synthetic peptide
  C6-30[CLDN6]_L1.107 vlCDR2
GATSLET

SEQ ID NO: 364 - protein, 9 aa, Artificial Sequence
  Description of Artificial Sequence: Synthetic peptide
  C6-30[CLDN6]_L1.107 vlCDR3
QQYWSSPLT

SEQ ID NO: 365 - protein, 107 aa, Artificial Sequence
  Description of Artificial Sequence: Synthetic polypeptide
  C6-30[CLDN6]_L1.114 Variable light (vl) domain
DIQMTQSPSSLSASVGDRVTITCQASEDIYLRLAWYQQKPGKVPKLLISGATSLETGVPSRFSGSGSGKDYTFTISSLQPEDIATYYCQQYWSSPLTFGGGTKVEIK

SEQ ID NO: 366 - protein, 11 aa, Artificial Sequence
  Description of Artificial Sequence: Synthetic peptide
  C6-30[CLDN6]_L1.114 vlCDR1
QASEDIYLRLA

SEQ ID NO: 367 - protein, 7 aa, Artificial Sequence
  Description of Artificial Sequence: Synthetic peptide
  C6-30[CLDN6]_L1.114 vlCDR2
GATSLET

SEQ ID NO: 368 - protein, 9 aa, Artificial Sequence
  Description of Artificial Sequence: Synthetic peptide
  C6-30[CLDN6]_L1.114 vlCDR3
QQYWSSPLT

SEQ ID NO: 369 - protein, 107 aa, Artificial Sequence
  Description of Artificial Sequence: Synthetic polypeptide
  C6-30[CLDN6]_L1.187 Variable light (vl) domain
DIQMTQSPSSLSASVGDRVTITCQASEDIYNRLAWYQQKPGKVPKLLISGATSLETGVPSRFSGSGSGKDYTFTISSLQPEDIATYYCQQYWSAPLTFGGGTKVEIK

SEQ ID NO: 370 - protein, 11 aa, Artificial Sequence
  Description of Artificial Sequence: Synthetic peptide
  C6-30[CLDN6]_L1.187 vlCDR1
QASEDIYNRLA

SEQ ID NO: 371 - protein, 7 aa, Artificial Sequence
  Description of Artificial Sequence: Synthetic peptide
  C6-30[CLDN6]_L1.187 vlCDR2
GATSLET

SEQ ID NO: 372 - protein, 9 aa, Artificial Sequence
  Description of Artificial Sequence: Synthetic peptide
  C6-30[CLDN6]_L1.187 vlCDR3
QQYWSAPLT

SEQ ID NO: 373 - protein, 107 aa, Artificial Sequence
  Description of Artificial Sequence: Synthetic polypeptide
  C6-30[CLDN6]_L1.189 Variable light (vl) domain
DIQMTQSPSSLSASVGDRVTITCQASEDIYNRLAWYQQKPGKVPKLLISGATSLETGVPSRFSGSGSGKDYTFTISSLQPEDIATYYCQQYWSGPLTFGGGTKVEIK

SEQ ID NO: 374 - protein, 11 aa, Artificial Sequence
  Description of Artificial Sequence: Synthetic peptide
  C6-30[CLDN6]_L1.189 vlCDR1
QASEDIYNRLA

SEQ ID NO: 375 - protein, 7 aa, Artificial Sequence
  Description of Artificial Sequence: Synthetic peptide
  C6-30[CLDN6]_L1.189 vlCDR2
GATSLET

SEQ ID NO: 376 - protein, 9 aa, Artificial Sequence
  Description of Artificial Sequence: Synthetic peptide
  C6-30[CLDN6]_L1.189 vlCDR3
QQYWSGPLT

SEQ ID NO: 377 - protein, 449 aa, Artificial Sequence
  Description of Artificial Sequence: Synthetic polypeptide
  XENP34218 Heavy Chain - C6-30[CLDN6]_H1
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 378 - protein, 214 aa, Artificial Sequence
  Description of Artificial Sequence: Synthetic polypeptide
  XENP34218 Light Chain - C6-30[CLDN6]_L1
DIQMTQSPSSLSASVGDRVTITCQASEDIYNRLAWYQQKPGKVPKLLISGATSLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 379 - protein, 449 aa, Artificial Sequence; identical to SEQ ID NO: 377
  Description of Artificial Sequence: Synthetic polypeptide
  XENP34219 Heavy Chain - C6-30[CLDN6]_H1

SEQ ID NO: 380 - protein, 214 aa, Artificial Sequence
  Description of Artificial Sequence: Synthetic polypeptide
  XENP34219 Light Chain - C6-30[CLDN6]_L2
DIQMTQSPDSLAVSLGERATINCKASEDIYNRLAWYQQKPGQVPKLLISGATSLETGVPSRFSGSGSGKDYTLTISSLQAEDVAVYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 381 - protein, 449 aa, Artificial Sequence
  Description of Artificial Sequence: Synthetic polypeptide
  XENP34220 Heavy Chain - C6-30[CLDN6]_H2
EVQLVQSGAEVKKPGESLRISCKTSGYTFTEYTMHWVRQMPGKSLEWMGGIDPNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 382 - protein, 214 aa, Artificial Sequence; identical to SEQ ID NO: 378
  Description of Artificial Sequence: Synthetic polypeptide
  XENP34220 Light Chain - C6-30[CLDN6]_L1

SEQ ID NO: 383 - protein, 449 aa, Artificial Sequence; identical to SEQ ID NO: 381
  Description of Artificial Sequence: Synthetic polypeptide
  XENP34221 Heavy Chain - C6-30[CLDN6]_H2

SEQ ID NO: 384 - protein, 214 aa, Artificial Sequence; identical to SEQ ID NO: 380
  Description of Artificial Sequence: Synthetic polypeptide
  XENP34221 Light Chain - C6-30[CLDN6]_L2

SEQ ID NO: 385 - protein, 449 aa, Artificial Sequence; identical to SEQ ID NO: 381
  Description of Artificial Sequence: Synthetic polypeptide
  XENP35044 Heavy Chain - C6-30[CLDN6]_H2

SEQ ID NO: 386 - protein, 209 aa, Artificial Sequence
  Description of Artificial Sequence: Synthetic polypeptide
  XENP35044 Light Chain - C6-30[CLDN6]_L1.1
DIQMTQSPSSLSASVGDRVTITCQASQDIYNRLAWYQQKPGKVPKLLISGATSLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSF

SEQ ID NO: 387 - protein, 449 aa, Artificial Sequence; identical to SEQ ID NO: 381
  Description of Artificial Sequence: Synthetic polypeptide
  XENP35047 Heavy Chain - C6-30[CLDN6]_H2

SEQ ID NO: 388 - protein, 214 aa, Artificial Sequence
  Description of Artificial Sequence: Synthetic polypeptide
  XENP35047 Light Chain - C6-30[CLDN6]_L1.4
DIQMTQSPSSLSASVGDRVTITCQASEDVYNRLAWYQQKPGKVPKLLISGATSLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 389 - protein, 449 aa, Artificial Sequence; identical to SEQ ID NO: 381
  Description of Artificial Sequence: Synthetic polypeptide
  XENP35050 Heavy Chain - C6-30[CLDN6]_H2

SEQ ID NO: 390 - protein, 214 aa, Artificial Sequence
  Description of Artificial Sequence: Synthetic polypeptide
  XENP35050 Light Chain - C6-30[CLDN6]_L1.7
DIQMTQSPSSLSASVGDRVTITCQASEDIYSRLAWYQQKPGKVPKLLISGATSLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 391 - protein, 449 aa, Artificial Sequence; identical to SEQ ID NO: 381
  Description of Artificial Sequence: Synthetic polypeptide
  XENP35059 Heavy Chain - C6-30[CLDN6]_H2

SEQ ID NO: 392 - protein, 214 aa, Artificial Sequence
  Description of Artificial Sequence: Synthetic polypeptide
  XENP35059 Light Chain - C6-30[CLDN6]_L1.16
DIQMTQSPSSLSASVGDRVTITCQASEDIYNRLAWYQQKPGKVPKLLISAATSLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 393 - protein, 449 aa, Artificial Sequence; identical to SEQ ID NO: 381
  Description of Artificial Sequence: Synthetic polypeptide
  XENP35061 Heavy Chain - C6-30[CLDN6]_H2

SEQ ID NO: 394 - protein, 214 aa, Artificial Sequence
  Description of Artificial Sequence: Synthetic polypeptide
  XENP35061 Light Chain - C6-30[CLDN6]_L1.18
DIQMTQSPSSLSASVGDRVTITCQASEDIYNRLAWYQQKPGKVPKLLISGTTSLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 395 - protein, 449 aa, Artificial Sequence; identical to SEQ ID NO: 381
  Description of Artificial Sequence: Synthetic polypeptide
  XENP35062 Heavy Chain - C6-30[CLDN6]_H2

SEQ ID NO: 396 - protein, 214 aa, Artificial Sequence
  Description of Artificial Sequence: Synthetic polypeptide
  XENP35062 Light Chain - C6-30[CLDN6]_L1.19
DIQMTQSPSSLSASVGDRVTITCQASEDIYNRLAWYQQKPGKVPKLLISGASSLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 397 - protein, 449 aa, Artificial Sequence; identical to SEQ ID NO: 381
  Description of Artificial Sequence: Synthetic polypeptide
  XENP35064 Heavy Chain - C6-30[CLDN6]_H2

SEQ ID NO: 398 - protein, 214 aa, Artificial Sequence
  Description of Artificial Sequence: Synthetic polypeptide
  XENP35064 Light Chain - C6-30[CLDN6]_L1.21
DIQMTQSPSSLSASVGDRVTITCQASEDIYNRLAWYQQKPGKVPKLLISGATNLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 399 - protein, 449 aa, Artificial Sequence; identical to SEQ ID NO: 381
  Description of Artificial Sequence: Synthetic polypeptide
  XENP35065 Heavy Chain - C6-30[CLDN6]_H2

SEQ ID NO: 400 - protein, 214 aa, Artificial Sequence
  Description of Artificial Sequence: Synthetic polypeptide
  XENP35065 Light Chain - C6-30[CLDN6]_L1.22
DIQMTQSPSSLSASVGDRVTITCQASEDIYNRLAWYQQKPGKVPKLLISGATQLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 401 - protein, 449 aa, Artificial Sequence; identical to SEQ ID NO: 381
  Description of Artificial Sequence: Synthetic polypeptide
  XENP35066 Heavy Chain - C6-30[CLDN6]_H2

SEQ ID NO: 402 - protein, 214 aa, Artificial Sequence
  Description of Artificial Sequence: Synthetic polypeptide
  XENP35066 Light Chain - C6-30[CLDN6]_L1.23
DIQMTQSPSSLSASVGDRVTITCQASEDIYNRLAWYQQKPGKVPKLLISGATSRETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 403 - protein, 449 aa, Artificial Sequence; identical to SEQ ID NO: 381
  Description of Artificial Sequence: Synthetic polypeptide
  XENP35070 Heavy Chain - C6-30[CLDN6]_H2

SEQ ID NO: 404 - protein, 214 aa, Artificial Sequence
  Description of Artificial Sequence: Synthetic polypeptide
  XENP35070 Light Chain - C6-30[CLDN6]_L1.27
DIQMTQSPSSLSASVGDRVTITCQASEDIYNRLAWYQQKPGKVPKLLISGATSLESGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 405 - protein, 449 aa, Artificial Sequence
  Description of Artificial Sequence: Synthetic polypeptide
  XENP35085 Heavy Chain - C6-30[CLDN6]_H1.1
QVQLVQSGAEVKKPGASVKVSCKTSGYTFTEYTMHWVRQAPGQSLEWMGGISPNNGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 406 - protein, 214 aa, Artificial Sequence; identical to SEQ ID NO: 378
  Description of Artificial Sequence: Synthetic polypeptide
  XENP35085 Light Chain - C6-30[CLDN6]_L1

SEQ ID NO: 407 - protein, 449 aa, Artificial Sequence
  Description of Artificial Sequence: Synthetic polypeptide
  XENP35086 Heavy Chain - C6-30[CLDN6]_H1.2
QVQLVQSGAEVKKPGASVKVSCKTSGYTFTEYTMHWVRQAPGQSLEWMGGINPNNGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 408 - protein, 214 aa, Artificial Sequence; identical to SEQ ID NO: 378
  Description of Artificial Sequence: Synthetic polypeptide
  XENP35086 Light Chain - C6-30[CLDN6]_L1

SEQ ID NO: 409 - protein, 449 aa, Artificial Sequence
  Description of Artificial Sequence: Synthetic polypeptide
  XENP35087 Heavy Chain - C6-30[CLDN6]_H1.3
QVQLVQSGAEVKKPGASVKVSCKTSGYTFTEYTMHWVRQAPGQSLEWMGGIDSNNGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 410 - protein, 214 aa, Artificial Sequence; identical to SEQ ID NO: 378
  Description of Artificial Sequence: Synthetic polypeptide
  XENP35087 Light Chain - C6-30[CLDN6]_L1

SEQ ID NO: 411 - protein, 449 aa, Artificial Sequence
  Description of Artificial Sequence: Synthetic polypeptide
  XENP35088 Heavy Chain - C6-30[CLDN6]_H1.4
QVQLVQSGAEVKKPGASVKVSCKTSGYTFTEYTMHWVRQAPGQSLEWMGGIDANNGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 412 - protein, 214 aa, Artificial Sequence; identical to SEQ ID NO: 378
  Description of Artificial Sequence: Synthetic polypeptide
  XENP35088 Light Chain - C6-30[CLDN6]_L1

SEQ ID NO: 413 - protein, 449 aa, Artificial Sequence
  Description of Artificial Sequence: Synthetic polypeptide
  XENP35089 Heavy Chain - C6-30[CLDN6]_H1.5
QVQLVQSGAEVKKPGASVKVSCKTSGYTFTEYTMHWVRQAPGQSLEWMGGIDPQNGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - protein, 214 aa, Artificial Sequence; identical to SEQ ID NO: 378
  Description of Artificial Sequence: Synthetic polypeptide
  XENP35089 Light Chain - C6-30[CLDN6]_L1

SEQ ID NO: 415 - protein, 449 aa, Artificial Sequence
  Description of Artificial Sequence: Synthetic polypeptide
  XENP35090 Heavy Chain - C6-30[CLDN6]_H1.6
QVQLVQSGAEVKKPGASVKVSCKTSGYTFTEYTMHWVRQAPGQSLEWMGGIDPNSGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 416 - protein, 214 aa, Artificial Sequence; identical to SEQ ID NO: 378
  Description of Artificial Sequence: Synthetic polypeptide
  XENP35090 Light Chain - C6-30[CLDN6]_L1

SEQ ID NO: 417 - protein, 449 aa, Artificial Sequence
  Description of Artificial Sequence: Synthetic polypeptide
  XENP35091 Heavy Chain - C6-30[CLDN6]_H1.7
QVQLVQSGAEVKKPGASVKVSCKTSGYTFTEYTMHWVRQAPGQSLEWMGGIDPNQGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 418 - protein, 214 aa, Artificial Sequence; identical to SEQ ID NO: 378
  Description of Artificial Sequence: Synthetic polypeptide
  XENP35091 Light Chain - C6-30[CLDN6]_L1

SEQ ID NO: 419 - protein, 449 aa, Artificial Sequence
  Description of Artificial Sequence: Synthetic polypeptide
  XENP35092 Heavy Chain - C6-30[CLDN6]_H1.8
QVQLVQSGAEVKKPGASVKVSCKTSGYTFTEYTMHWVRQAPGQSLEWMGGIDPNNDNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 420 - protein, 214 aa, Artificial Sequence; identical to SEQ ID NO: 378
  Description of Artificial Sequence: Synthetic polypeptide
  XENP35092 Light Chain - C6-30[CLDN6]_L1

SEQ ID NO: 421 - protein, 449 aa, Artificial Sequence
  Description of Artificial Sequence: Synthetic polypeptide
  XENP35093 Heavy Chain - C6-30[CLDN6]_H1.9
QVQLVQSGAEVKKPGASVKVSCKTSGYTFTEYTMHWVRQAPGQSLEWMGGIDPNNANTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 422 - protein, 214 aa, Artificial Sequence; identical to SEQ ID NO: 378
  Description of Artificial Sequence: Synthetic polypeptide
  XENP35093 Light Chain - C6-30[CLDN6]_L1

SEQ ID NO: 423 - protein, 449 aa, Artificial Sequence
  Description of Artificial Sequence: Synthetic polypeptide
  XENP35094 Heavy Chain - C6-30[CLDN6]_H2.1
EVQLVQSGAEVKKPGESLRISCKTSGYTFTEYTMHWVRQMPGKSLEWMGGISPNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 424 - protein, 214 aa, Artificial Sequence; identical to SEQ ID NO: 378
  Description of Artificial Sequence: Synthetic polypeptide
  XENP35094 Light Chain - C6-30[CLDN6]_L1

SEQ ID NO: 425 - protein, 449 aa, Artificial Sequence
  Description of Artificial Sequence: Synthetic polypeptide
  XENP35095 Heavy Chain - C6-30[CLDN6]_H2.2
EVQLVQSGAEVKKPGESLRISCKTSGYTFTEYTMHWVRQMPGKSLEWMGGITPNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 426 - protein, 214 aa, Artificial Sequence; identical to SEQ ID NO: 378
  Description of Artificial Sequence: Synthetic polypeptide
  XENP35095 Light Chain - C6-30[CLDN6]_L1

SEQ ID NO: 427 - protein, 449 aa, Artificial Sequence; identical to SEQ ID NO: 183
  Description of Artificial Sequence: Synthetic polypeptide
  XENP35096 Heavy Chain - C6-30[CLDN6]_H2.3

SEQ ID NO: 428 - protein, 214 aa, Artificial Sequence; identical to SEQ ID NO: 378
  Description of Artificial Sequence: Synthetic polypeptide
  XENP35096 Light Chain - C6-30[CLDN6]_L1

SEQ ID NO: 429 - protein, 449 aa, Artificial Sequence
  Description of Artificial Sequence: Synthetic polypeptide
  XENP35097 Heavy Chain - C6-30[CLDN6]_H2.4
EVQLVQSGAEVKKPGESLRISCKTSGYTFTEYTMHWVRQMPGKSLEWMGGIDGNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 430 - protein, 214 aa, Artificial Sequence; identical to SEQ ID NO: 378
  Description of Artificial Sequence: Synthetic polypeptide
  XENP35097 Light Chain - C6-30[CLDN6]_L1

SEQ ID NO: 431 - protein, 449 aa, Artificial Sequence
  Description of Artificial Sequence: Synthetic polypeptide
  XENP35098 Heavy Chain - C6-30[CLDN6]_H2.5
EVQLVQSGAEVKKPGESLRISCKTSGYTFTEYTMHWVRQMPGKSLEWMGGIDPQNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 432 - protein, 214 aa, Artificial Sequence; identical to SEQ ID NO: 378
  Description of Artificial Sequence: Synthetic polypeptide
  XENP35098 Light Chain - C6-30[CLDN6]_L1

SEQ ID NO: 433 - protein, 449 aa, Artificial Sequence
  Description of Artificial Sequence: Synthetic polypeptide
  XENP35099 Heavy Chain - C6-30[CLDN6]_H2.6
EVQLVQSGAEVKKPGESLRISCKTSGYTFTEYTMHWVRQMPGKSLEWMGGIDPNDGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 434 - protein, 214 aa, Artificial Sequence; identical to SEQ ID NO: 378
  Description of Artificial Sequence: Synthetic polypeptide
  XENP35099 Light Chain - C6-30[CLDN6]_L1

SEQ ID NO: 435 - protein, 449 aa, Artificial Sequence
  Description of Artificial Sequence: Synthetic polypeptide
  XENP35100 Heavy Chain - C6-30[CLDN6]_H2.7
EVQLVQSGAEVKKPGESLRISCKTSGYTFTEYTMHWVRQMPGKSLEWMGGIDPNQGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 436 - protein, 214 aa, Artificial Sequence; identical to SEQ ID NO: 378
  Description of Artificial Sequence: Synthetic polypeptide
  XENP35100 Light Chain - C6-30[CLDN6]_L1

SEQ ID NO: 437 - protein, 449 aa, Artificial Sequence
  Description of Artificial Sequence: Synthetic polypeptide
  XENP35101 Heavy Chain - C6-30[CLDN6]_H2.8
EVQLVQSGAEVKKPGESLRISCKTSGYTFTEYTMHWVRQMPGKSLEWMGGIDPNNDNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 438 - protein, 214 aa, Artificial Sequence; identical to SEQ ID NO: 378
  Description of Artificial Sequence: Synthetic polypeptide
  XENP35101 Light Chain - C6-30[CLDN6]_L1

SEQ ID NO: 439 - protein, 449 aa, Artificial Sequence
  Description of Artificial Sequence: Synthetic polypeptide
  XENP35102 Heavy Chain - C6-30[CLDN6]_H2.9
EVQLVQSGAEVKKPGESLRISCKTSGYTFTEYTMHWVRQMPGKSLEWMGGIDPNNANTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 440 - protein, 214 aa, Artificial Sequence; identical to SEQ ID NO: 378
  Description of Artificial Sequence: Synthetic polypeptide
  XENP35102 Light Chain - C6-30[CLDN6]_L1

SEQ ID NO: 441 - protein, 449 aa, Artificial Sequence; identical to SEQ ID NO: 381
  Description of Artificial Sequence: Synthetic polypeptide
  XENP35865 Heavy Chain - C6-30[CLDN6]_H2

SEQ ID NO: 442 - protein, 214 aa, Artificial Sequence
  Description of Artificial Sequence: Synthetic polypeptide
  XENP35865 Light Chain - C6-30[CLDN6]_L1.60
DIQMTQSPSSLSASVGDRVTITCQASEDIYNRLAWYQQKPGKVPKLLISGATSLETGVPSRFSGSGSGKDYTFTISSLQPEDIATYYCQQLWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 443 - protein, 449 aa, Artificial Sequence
  Description of Artificial Sequence: Synthetic polypeptide
  XENP35883 Heavy Chain - C6-30[CLDN6]_H1.19
QVQLVQSGAEVKKPGASVKVSCKTSGYTFTEYTMHWVRQAPGQSLEWMGGIDPNNGNTHYNQKFQGRVTITVDKSASTAYMELSSLRSEDTATYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 444 - protein, 214 aa, Artificial Sequence; identical to SEQ ID NO: 378
  Description of Artificial Sequence: Synthetic polypeptide
  XENP35883 Light Chain - C6-30[CLDN6]_L1

SEQ ID NO: 445 - protein, 449 aa, Artificial Sequence
  Description of Artificial Sequence: Synthetic polypeptide
  XENP35886 Heavy Chain - C6-30[CLDN6]_H1.22
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARILYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 446 - protein, 214 aa, Artificial Sequence; identical to SEQ ID NO: 378
  Description of Artificial Sequence: Synthetic polypeptide
  XENP35886 Light Chain - C6-30[CLDN6]_L1

SEQ ID NO: 447 - protein, 449 aa, Artificial Sequence
  Description of Artificial Sequence: Synthetic polypeptide
  XENP35888 Heavy Chain - C6-30[CLDN6]_H1.24
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYLGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 448 - protein, 214 aa, Artificial Sequence; identical to SEQ ID NO: 378
  Description of Artificial Sequence: Synthetic polypeptide
  XENP35888 Light Chain - C6-30[CLDN6]_L1

SEQ ID NO: 449 - protein, 449 aa, Artificial Sequence
  Description of Artificial Sequence: Synthetic polypeptide
  XENP35890 Heavy Chain - C6-30[CLDN6]_H2.11
EVQLVQSGAEVKKPGESLRISCKTSGYSFTEYTMHWVRQMPGKSLEWMGGIDPNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 450 - protein, 214 aa, Artificial Sequence; identical to SEQ ID NO: 378
  Description of Artificial Sequence: Synthetic polypeptide
  XENP35890 Light Chain - C6-30[CLDN6]_L1

SEQ ID NO: 451 - protein, 449 aa, Artificial Sequence
  Description of Artificial Sequence: Synthetic polypeptide
  XENP35891 Heavy Chain - C6-30[CLDN6]_H2.12
EVQLVQSGAEVKKPGESLRISCKTSGYDFTEYTMHWVRQMPGKSLEWMGGIDPNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 452 - protein, 214 aa, Artificial Sequence; identical to SEQ ID NO: 378
  Description of Artificial Sequence: Synthetic polypeptide
  XENP35891 Light Chain - C6-30[CLDN6]_L1

SEQ ID NO: 453 - protein, 449 aa, Artificial Sequence; identical to SEQ ID NO: 381
  Description of Artificial Sequence: Synthetic polypeptide
  XENP35979 Heavy Chain - C6-30[CLDN6]_H2

SEQ ID NO: 454 - protein, 214 aa, Artificial Sequence
  Description of Artificial Sequence: Synthetic polypeptide
  XENP35979 Light Chain - C6-30[CLDN6]_L1.187
DIQMTQSPSSLSASVGDRVTITCQASEDIYNRLAWYQQKPGKVPKLLISGATSLETGVPSRFSGSGSGKDYTFTISSLQPEDIATYYCQQYWSAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 455 - protein, 449 aa, Artificial Sequence; identical to SEQ ID NO: 381
  Description of Artificial Sequence: Synthetic polypeptide
  XENP35981 Heavy Chain - C6-30[CLDN6]_H2

SEQ ID NO: 456 - protein, 214 aa, Artificial Sequence; identical to SEQ ID NO: 184
  Description of Artificial Sequence: Synthetic polypeptide
  XENP35981 Light Chain - C6-30[CLDN6]_L1.189

SEQ ID NO: 457 - protein, 449 aa, Artificial Sequence; identical to SEQ ID NO: 381
  Description of Artificial Sequence: Synthetic polypeptide
  XENP35929 Heavy Chain - C6-30[CLDN6]_H2

SEQ ID NO: 458 - protein, 214 aa, Artificial Sequence
  Description of Artificial Sequence: Synthetic polypeptide
  XENP35929 Light Chain - C6-30[CLDN6]_L1.107
DIQMTQSPSSLSASVGDRVTITCQASEDIVNRLAWYQQKPGKVPKLLISGATSLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 459 - protein, 449 aa, Artificial Sequence; identical to SEQ ID NO: 381
  Description of Artificial Sequence: Synthetic polypeptide
  XENP35936 Heavy Chain - C6-30[CLDN6]_H2

SEQ ID NO: 460 - protein, 214 aa, Artificial Sequence
  Description of Artificial Sequence: Synthetic polypeptide
  XENP35936 Light Chain - C6-30[CLDN6]_L1.114
DIQMTQSPSSLSASVGDRVTITCQASEDIYLRLAWYQQKPGKVPKLLISGATSLETGVPSRFSGSGSGKDYTFTISSLQPEDIATYYCQQYWSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 461 - protein, 449 aa, Artificial Sequence
  Description of Artificial Sequence: Synthetic polypeptide
  XENP36021 Heavy Chain - C6-30[CLDN6]_H2.71
EVQLVQSGAEVKKPGESLRISCKTSGYTFTEYTMHWVRQMPGKSLEWMGGIDLNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 462 - protein, 214 aa, Artificial Sequence; identical to SEQ ID NO: 378
  Description of Artificial Sequence: Synthetic polypeptide
  XENP36021 Light Chain - C6-30[CLDN6]_L1

SEQ ID NO: 463 - protein, 449 aa, Artificial Sequence
  Description of Artificial Sequence: Synthetic polypeptide
  XENP36022 Heavy Chain - C6-30[CLDN6]_H2.72
EVQLVQSGAEVKKPGESLRISCKTSGYTFTEYTMHWVRQMPGKSLEWMGGIDANNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 464 - protein, 214 aa, Artificial Sequence; identical to SEQ ID NO: 378
  Description of Artificial Sequence: Synthetic polypeptide
  XENP36022 Light Chain - C6-30[CLDN6]_L1

SEQ ID NO: 465 - protein, 449 aa, Artificial Sequence
  Description of Artificial Sequence: Synthetic polypeptide
  XENP36025 Heavy Chain - C6-30[CLDN6]_H2.75
EVQLVQSGAEVKKPGESLRISCKTSGYTFTEYTMHWVRQMPGKSLEWMGGIDPHNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 466 - protein, 214 aa, Artificial Sequence; identical to SEQ ID NO: 378
  Description of Artificial Sequence: Synthetic polypeptide
  XENP36025 Light Chain - C6-30[CLDN6]_L1

SEQ ID NO: 467 - protein, 449 aa, Artificial Sequence
  Description of Artificial Sequence: Synthetic polypeptide
  XENP36040 Heavy Chain - C6-30[CLDN6]_H2.90
EVQLVQSGAEVKKPGESLRISCKTSGYTFTEYTMHWVRQMPGKSLEWMGGIDPNNLNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 468 - protein, 214 aa, Artificial Sequence; identical to SEQ ID NO: 378
  Description of Artificial Sequence: Synthetic polypeptide
  XENP36040 Light Chain - C6-30[CLDN6]_L1

SEQ ID NO: 469 - protein, 449 aa, Artificial Sequence
  Description of Artificial Sequence: Synthetic polypeptide
  XENP36041 Heavy Chain - C6-30[CLDN6]_H2.91
EVQLVQSGAEVKKPGESLRISCKTSGYTFTEYTMHWVRQMPGKSLEWMGGIDPNNFNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 470 - protein, 214 aa, Artificial Sequence; identical to SEQ ID NO: 378
  Description of Artificial Sequence: Synthetic polypeptide
  XENP36041 Light Chain - C6-30[CLDN6]_L1

SEQ ID NO: 471 - protein, 449 aa, Artificial Sequence
  Description of Artificial Sequence: Synthetic polypeptide
  XENP36065 Heavy Chain - C6-30[CLDN6]_H2.118
EVQLVQSGAEVKKPGESLRISCKTSGYTFTEYTMHWVRQMPGKSLEWMGGIDPNNGNTHYNQKKQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 472 - protein, 214 aa, Artificial Sequence; identical to SEQ ID NO: 378
  Description of Artificial Sequence: Synthetic polypeptide
  XENP36065 Light Chain - C6-30[CLDN6]_L1

SEQ ID NO: 473 - protein, 449 aa, Artificial Sequence
  Description of Artificial Sequence: Synthetic polypeptide
  XENP36066 Heavy Chain - C6-30[CLDN6]_H2.119
EVQLVQSGAEVKKPGESLRISCKTSGYTFTEYTMHWVRQMPGKSLEWMGGIDPNNGNTHYNQKFEGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 474 - protein, 214 aa, Artificial Sequence; identical to SEQ ID NO: 378
  Description of Artificial Sequence: Synthetic polypeptide
  XENP36066 Light Chain - C6-30[CLDN6]_L1

SEQ ID NO: 475 - protein, 449 aa, Artificial Sequence; identical to SEQ ID NO: 445
  Description of Artificial Sequence: Synthetic polypeptide
  XENP36956 Heavy Chain - C6-30[CLDN6]_H1.22

SEQ ID NO: 476 - protein, 214 aa, Artificial Sequence; identical to SEQ ID NO: 454
  Description of Artificial Sequence: Synthetic polypeptide
  XENP36956 Light Chain - C6-30[CLDN6]_L1.187

SEQ ID NO: 477 - protein, 449 aa, Artificial Sequence; identical to SEQ ID NO: 445
  Description of Artificial Sequence: Synthetic polypeptide
  XENP36960 Heavy Chain - C6-30[CLDN6]_H1.22

SEQ ID NO: 478 - protein, 214 aa, Artificial Sequence; identical to SEQ ID NO: 184
  Description of Artificial Sequence: Synthetic polypeptide
  XENP36960 Light Chain - C6-30[CLDN6]_L1.189

SEQ ID NO: 479 - protein, 449 aa, Artificial Sequence; identical to SEQ ID NO: 183
  Description of Artificial Sequence: Synthetic polypeptide
  XENP36968 Heavy Chain - C6-30[CLDN6]_H2.3

SEQ ID NO: 480 - protein, 214 aa, Artificial Sequence; identical to SEQ ID NO: 184
  Description of Artificial Sequence: Synthetic polypeptide
  XENP36968 Light Chain - C6-30[CLDN6]_L1.189

SEQ ID NO: 481 - protein, 449 aa, Artificial Sequence; identical to SEQ ID NO: 421
  Description of Artificial Sequence: Synthetic polypeptide
  XENP36963 Heavy Chain - C6-30[CLDN6]_H1.9

SEQ ID NO: 482 - protein, 214 aa, Artificial Sequence; identical to SEQ ID NO: 184
  Description of Artificial Sequence: Synthetic polypeptide
  XENP36963 Light Chain - C6-30[CLDN6]_L1.189

SEQ ID NO: 483 - protein, 449 aa, Artificial Sequence; identical to SEQ ID NO: 183
  Description of Artificial Sequence: Synthetic polypeptide
  XENP36964 Heavy Chain - C6-30[CLDN6]_H2.3

SEQ ID NO: 484 - protein, 214 aa, Artificial Sequence; identical to SEQ ID NO: 454
  Description of Artificial Sequence: Synthetic polypeptide
  XENP36964 Light Chain - C6-30[CLDN6]_L1.187

SEQ ID NO: 485 - protein, 449 aa, Artificial Sequence; identical to SEQ ID NO: 451
  Description of Artificial Sequence: Synthetic polypeptide
  XENP36965 Heavy Chain - C6-30[CLDN6]_H2.12

SEQ ID NO: 486 - protein, 214 aa, Artificial Sequence; identical to SEQ ID NO: 454
  Description of Artificial Sequence: Synthetic polypeptide
  XENP36965 Light Chain - C6-30[CLDN6]_L1.187

SEQ ID NO: 487 - protein, 449 aa, Artificial Sequence; identical to SEQ ID NO: 447
  Description of Artificial Sequence: Synthetic polypeptide
  XENP36957 Heavy Chain - C6-30[CLDN6]_H1.24

SEQ ID NO: 488 - protein, 214 aa, Artificial Sequence; identical to SEQ ID NO: 454
  Description of Artificial Sequence: Synthetic polypeptide
  XENP36957 Light Chain - C6-30[CLDN6]_L1.187

SEQ ID NO: 489 - protein, 449 aa, Artificial Sequence; identical to SEQ ID NO: 443
  Description of Artificial Sequence: Synthetic polypeptide
  XENP36958 Heavy Chain - C6-30[CLDN6]_H1.19

SEQ ID NO: 490 - protein, 214 aa, Artificial Sequence; identical to SEQ ID NO: 454
  Description of Artificial Sequence: Synthetic polypeptide
  XENP36958 Light Chain - C6-30[CLDN6]_L1.187

SEQ ID NO: 491 - protein, 449 aa, Artificial Sequence; identical to SEQ ID NO: 421
  Description of Artificial Sequence: Synthetic polypeptide
  XENP36959 Heavy Chain - C6-30[CLDN6]_H1.9

SEQ ID NO: 492 - protein, 214 aa, Artificial Sequence; identical to SEQ ID NO: 454
  Description of Artificial Sequence: Synthetic polypeptide
  XENP36959 Light Chain - C6-30[CLDN6]_L1.187

SEQ ID NO: 493 - protein, 449 aa, Artificial Sequence; identical to SEQ ID NO: 447
  Description of Artificial Sequence: Synthetic polypeptide
  XENP36961 Heavy Chain - C6-30[CLDN6]_H1.24

SEQ ID NO: 494 - protein, 214 aa, Artificial Sequence; identical to SEQ ID NO: 184
  Description of Artificial Sequence: Synthetic polypeptide
  XENP36961 Light Chain - C6-30[CLDN6]_L1.189

SEQ ID NO: 495 - protein, 449 aa, Artificial Sequence; identical to SEQ ID NO: 443
  Description of Artificial Sequence: Synthetic polypeptide
  XENP36962 Heavy Chain - C6-30[CLDN6]_H1.19

SEQ ID NO: 496 - protein, 214 aa, Artificial Sequence; identical to SEQ ID NO: 184
  Description of Artificial Sequence: Synthetic polypeptide
  XENP36962 Light Chain - C6-30[CLDN6]_L1.189

SEQ ID NO: 497 - protein, 449 aa, Artificial Sequence; identical to SEQ ID NO: 469
  Description of Artificial Sequence: Synthetic polypeptide
  XENP36966 Heavy Chain - C6-30[CLDN6]_H2.91

SEQ ID NO: 498 - protein, 214 aa, Artificial Sequence; identical to SEQ ID NO: 454
  Description of Artificial Sequence: Synthetic polypeptide
  XENP36966 Light Chain - C6-30[CLDN6]_L1.187

SEQ ID NO: 499 - protein, 449 aa, Artificial Sequence; identical to SEQ ID NO: 471
  Description of Artificial Sequence: Synthetic polypeptide
  XENP36967 Heavy Chain - C6-30[CLDN6]_H2.118

SEQ ID NO: 500 - protein, 214 aa, Artificial Sequence; identical to SEQ ID NO: 454
  Description of Artificial Sequence: Synthetic polypeptide
  XENP36967 Light Chain - C6-30[CLDN6]_L1.187

SEQ ID NO: 501 - protein, 449 aa, Artificial Sequence; identical to SEQ ID NO: 451
  Description of Artificial Sequence: Synthetic polypeptide
  XENP36969 Heavy Chain - C6-30[CLDN6]_H2.12

SEQ ID NO: 502 - protein, 214 aa, Artificial Sequence; identical to SEQ ID NO: 184
  Description of Artificial Sequence: Synthetic polypeptide
  XENP36969 Light Chain - C6-30[CLDN6]_L1.189

SEQ ID NO: 503 - protein, 449 aa, Artificial Sequence; identical to SEQ ID NO: 469
  Description of Artificial Sequence: Synthetic polypeptide
  XENP36970 Heavy Chain - C6-30[CLDN6]_H2.91

SEQ ID NO: 504 - protein, 214 aa, Artificial Sequence; identical to SEQ ID NO: 184
  Description of Artificial Sequence: Synthetic polypeptide
  XENP36970 Light Chain - C6-30[CLDN6]_L1.189

SEQ ID NO: 505 - protein, 449 aa, Artificial Sequence; identical to SEQ ID NO: 377
  Description of Artificial Sequence: Synthetic polypeptide
  XENP36972 Heavy Chain - C6-30[CLDN6]_H1

SEQ ID NO: 506 - protein, 214 aa, Artificial Sequence; identical to SEQ ID NO: 454
  Description of Artificial Sequence: Synthetic polypeptide
  XENP36972 Light Chain - C6-30[CLDN6]_L1.187

SEQ ID NO: 507 - protein, 449 aa, Artificial Sequence; identical to SEQ ID NO: 471
  Description of Artificial Sequence: Synthetic polypeptide
  XENP36971 Heavy Chain - C6-30[CLDN6]_H2.118

SEQ ID NO: 508 - protein, 214 aa, Artificial Sequence; identical to SEQ ID NO: 184
  Description of Artificial Sequence: Synthetic polypeptide
  XENP36971 Light Chain - C6-30[CLDN6]_L1.189

SEQ ID NO: 509 - protein, 449 aa, Artificial Sequence; identical to SEQ ID NO: 377
  Description of Artificial Sequence: Synthetic polypeptide
  XENP36973 Heavy Chain - C6-30[CLDN6]_H1

SEQ ID NO: 510 - protein, 214 aa, Artificial Sequence; identical to SEQ ID NO: 184
  Description of Artificial Sequence: Synthetic polypeptide
  XENP36973 Light Chain - C6-30[CLDN6]_L1.189

SEQ ID NO: 511 - protein, 446 aa, Artificial Sequence
  Description of Artificial Sequence: Synthetic polypeptide
  XENP26863 Heavy Chain - mAb206-LCC[CLDN6]_H0
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 512 - protein, 214 aa, Artificial Sequence
  Description of Artificial Sequence: Synthetic polypeptide
  XENP26863 Light Chain - mAb206-LCC[CLDN6]_L0
QIVLTQSPAIMSASPGEKVTITCSASSSVSYLHWFQQKPGTSPKLWVYSTSNLPSGVPARFGGSGSGTSYSLTISRMEAEDAATYYCQQRSIYPPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 513 - protein, 446 aa, Artificial Sequence
  Description of Artificial Sequence: Synthetic polypeptide
  XENP26849 Chain 1 - mAb206-LCC[CLDN6]_H0_IgG1_pI(-)_ Isosteric_A_/PVA_/S267K/L368D/K370S
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 514 - protein, 485 aa, Artificial Sequence
  Description of Artificial Sequence: Synthetic polypeptide
  XENP26849 Chain 2 - [ANTI-CD3]_H1.30_L1.47_scFv(GKPGS)4_Fc(216) _IgG1_C220S/PVA_/S267K/S364K/E357Q
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 515 - protein, 214 aa, Artificial Sequence; identical to SEQ ID NO: 512
  Description of Artificial Sequence: Synthetic polypeptide
  XENP26849 Chain 3 - mAb206-LCC[CLDN6]_L0

SEQ ID NO: 516 - protein, 449 aa, Artificial Sequence
  Description of Artificial Sequence: Synthetic polypeptide
  XENP34229 Chain 1 - C6-30[CLDN6]_H1_IgG1_PVA_/S267K IgG1_pI(-) _Isosteric_A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 517 - protein, 485 aa, Artificial Sequence
  Description of Artificial Sequence: Synthetic polypeptide
  XENP34229 Chain 2 - [ANTI-CD3]_L1.47_H1.30_scFv(GKPGS)4_Fc(216) _IgG1_C220S/PVA_/S267K/S364K/E357Q
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 518 - protein, 214 aa, Artificial Sequence; identical to SEQ ID NO: 378
  Description of Artificial Sequence: Synthetic polypeptide
  XENP34229 Chain 3 - C6-30[CLDN6]_L1

SEQ ID NO: 519 - protein, 449 aa, Artificial Sequence
  Description of Artificial Sequence: Synthetic polypeptide
  XENP34637 Chain 1 - C6-30[CLDN6]_H2_L1_IgG1_pI(-)_Isosteric_A _PVA_/S267K/L368D/K370S
EVQLVQSGAEVKKPGESLRISCKTSGYTFTEYTMHWVRQMPGKSLEWMGGIDPNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 520 - protein, 485 aa, Artificial Sequence; identical to SEQ ID NO: 514
  Description of Artificial Sequence: Synthetic polypeptide
  XENP34637 Chain 2 - [ANTI-CD3]_H1.30_L1.47_scFv(GKPGS)4_Fc(216) _IgG1_C220S/PVA_/S267K/S364K/E357Q

SEQ ID NO: 521 - protein, 214 aa, Artificial Sequence; identical to SEQ ID NO: 378
  Description of Artificial Sequence: Synthetic polypeptide
  XENP34637 Chain 3 - C6-30[CLDN6]_L1

SEQ ID NO: 522 - protein, 449 aa, Artificial Sequence; identical to SEQ ID NO: 516
  Description of Artificial Sequence: Synthetic polypeptide
  XENP35385 Chain 1 - C6-30[CLDN6]_H1_IgG1_PVA_/S267K IgG1_pI(-) _Isosteric_A_PVA_/S267K/L368D/K370S

SEQ ID NO: 523 - protein, 485 aa, Artificial Sequence
  Description of Artificial Sequence: Synthetic polypeptide
  XENP35385 Chain 2 - [ANTI-CD3]_L1.47_H1.32_scFv(GKPGS)4_Fc(216) _IgG1_C220S/PVA_/S267K/S364K/E357Q
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 524 - protein, 214 aa, Artificial Sequence; identical to SEQ ID NO: 378
  Description of Artificial Sequence: Synthetic polypeptide
  XENP35385 Chain 3 - C6-30[CLDN6]_L1

SEQ ID NO: 525 - protein, 449 aa, Artificial Sequence; identical to SEQ ID NO: 519
  Description of Artificial Sequence: Synthetic polypeptide
  XENP35387 Chain 1 - C6-30[CLDN6]_H2_IgG1_PVA_/S267K IgG1_pI(-) _Isosteric_A_PVA_/S267K/L368D/K370S

SEQ ID NO: 526 - protein, 485 aa, Artificial Sequence; identical to SEQ ID NO: 523
  Description of Artificial Sequence: Synthetic polypeptide
  XENP35387 Chain 2 - [ANTI-CD3]_L1.47_H1.32_scFv(GKPGS)4_Fc(216) _IgG1_C220S/PVA_/S267K/S364K/E357Q

SEQ ID NO: 527 - protein, 214 aa, Artificial Sequence; identical to SEQ ID NO: 378
  Description of Artificial Sequence: Synthetic polypeptide
  XENP35387 Chain 3 - C6-30[CLDN6]_L1

SEQ ID NO: 528 - protein, 449 aa, Artificial Sequence; identical to SEQ ID NO: 516
  Description of Artificial Sequence: Synthetic polypeptide
  XENP34233 Chain 1 - C6-30[CLDN6]_H1_IgG1_pI(-)_Isosteric_A_PVA _/S267K/L368D/K370S

SEQ ID NO: 529 - protein, 722 aa, Artificial Sequence
  Description of Artificial Sequence: Synthetic polypeptide
  XENP34233 Chain 2 - C6-30[CLDN6]_H1_Fab_(G4S)2_[ANTI-CD3]_L1.47 _H1.30_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 530 - protein, 214 aa, Artificial Sequence; identical to SEQ ID NO: 378
  Description of Artificial Sequence: Synthetic polypeptide
  XENP34233 Chain 3 - C6-30[CLDN6]_H1

SEQ ID NO: 531 - protein, 449 aa, Artificial Sequence; identical to SEQ ID NO: 519
  Description of Artificial Sequence: Synthetic polypeptide
  XENP34638 Chain 1 - C6-30[CLDN6]_H2_IgG1_pI(-)_Isosteric_A_PVA _/S267K/L368D/K370S

SEQ ID NO: 532 - protein, 722 aa, Artificial Sequence
  Description of Artificial Sequence: Synthetic polypeptide
  XENP34638 Chain 2 - C6-30[CLDN6]_H2_(G4S)2_[ANTI-CD3]_L1.47_H1.30 _scFv(GKPGS)4_(G4S)2_Fc(222)_IgG1_PVA_/S267K/S364K/E357Q
EVQLVQSGAEVKKPGESLRISCKTSGYTFTEYTMHWVRQMPGKSLEWMGGIDPNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 533 - protein, 214 aa, Artificial Sequence; identical to SEQ ID NO: 378
  Description of Artificial Sequence: Synthetic polypeptide
  XENP34638 Chain 3 - C6-30[CLDN6]_H2

SEQ ID NO: 534 - protein, 449 aa, Artificial Sequence; identical to SEQ ID NO: 516
  Description of Artificial Sequence: Synthetic polypeptide
  XENP35386 Chain 1 - C6-30[CLDN6]_H1_IgG1_pI(-)_Isosteric_A _PVA_/S267K/L368D/K370S

SEQ ID NO: 535 - protein, 722 aa, Artificial Sequence
  Description of Artificial Sequence: Synthetic polypeptide
  XENP35386 Chain 2 - C6-30[CLDN6]_H1_L1_Fab_(G4S)2_Fc(222) _IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 536 - protein, 214 aa, Artificial Sequence; identical to SEQ ID NO: 378
  Description of Artificial Sequence: Synthetic polypeptide
  XENP35386 Chain 3 - C6-30[CLDN6]_H1

SEQ ID NO: 537 - protein, 449 aa, Artificial Sequence; identical to SEQ ID NO: 519
  Description of Artificial Sequence: Synthetic polypeptide
  XENP35388 Chain 1 - C6-30[CLDN6]_H2_IgG1_pI(-)_Isosteric _A_PVA_/S267K/L368D/K370S

SEQ ID NO: 538 - protein, 722 aa, Artificial Sequence
  Description of Artificial Sequence: Synthetic polypeptide
  XENP35388 Chain 2 - C6-30[CLDN6]_H2_L1_Fab_(G4S)2_Fc(222)_IgG1 _PVA_/S267K/S364K/E357Q
EVQLVQSGAEVKKPGESLRISCKTSGYTFTEYTMHWVRQMPGKSLEWMGGIDPNNGNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 539 - protein, 214 aa, Artificial Sequence; identical to SEQ ID NO: 378
  Description of Artificial Sequence: Synthetic polypeptide
  XENP35388 Chain 3 - C6-30[CLDN6]_H2

SEQ ID NO: 540 - protein, 449 aa, Artificial Sequence
  Description of Artificial Sequence: Synthetic polypeptide
  XENP37227 Chain 1 - C6-30[CLDN6]_H1.9_IgG1_pI(-)_Isosteric_ A_PVA_/S267K/L368D/K370S
QVQLVQSGAEVKKPGASVKVSCKTSGYTFTEYTMHWVRQAPGQSLEWMGGIDPNNANTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 541 - protein, 722 aa, Artificial Sequence
  Description of Artificial Sequence: Synthetic polypeptide
  XENP37227 Chain 2 - C6-30[CLDN6]_H1.9_(G4S)2_[ANTI-CD3]_L1.47 _H1.32_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNANTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 542 - protein, 214 aa, Artificial Sequence; identical to SEQ ID NO: 454
  Description of Artificial Sequence: Synthetic polypeptide
  XENP37227 Chain 3 - C6-30[CLDN6]_H1.9

SEQ ID NO: 543 - protein, 449 aa, Artificial Sequence
  Description of Artificial Sequence: Synthetic polypeptide
  XENP37228 Chain 1 - C6-30[CLDN6]_H1.19_IgG1_pI(-)_Isosteric _A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSASTAYMELSSLRSEDTATYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 544 - protein, 722 aa, Artificial Sequence
  Description of Artificial Sequence: Synthetic polypeptide
  XENP37228 Chain 2 - C6-30[CLDN6]_H1.19_(G4S)2_[ANTI-CD3]_L1.47 _H1.32_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSASTAYMELSSLRSEDTATYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 545 - protein, 214 aa, Artificial Sequence; identical to SEQ ID NO: 454
  Description of Artificial Sequence: Synthetic polypeptide
  XENP37228 Chain 3 - C6-30[CLDN6]_H1.19

SEQ ID NO: 546 - protein, 449 aa, Artificial Sequence
  Description of Artificial Sequence: Synthetic polypeptide
  XENP37229 Chain 1 - C6-30[CLDN6]_H1.22_IgG1_pI(-)_Isosteric _A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARILYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 547 - protein, 722 aa, Artificial Sequence
  Description of Artificial Sequence: Synthetic polypeptide
  XENP37229 Chain 2 - C6-30[CLDN6]_H1.22_(G4S)2_[ANTI-CD3]_L1.47 _H1.32_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARILYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 548 - protein, 214 aa, Artificial Sequence; identical to SEQ ID NO: 454
  Description of Artificial Sequence: Synthetic polypeptide
  XENP37229 Chain 3 - C6-30[CLDN6]_H1.22

SEQ ID NO: 549 - protein, 449 aa, Artificial Sequence; identical to SEQ ID NO: 546
  Description of Artificial Sequence: Synthetic polypeptide
  XENP37230 Chain 1 - C6-30[CLDN6]_H1.22_IgG1_pI(-)_Isosteric _A_PVA_/S267K/L368D/K370S

SEQ ID NO: 550 - protein, 722 aa, Artificial Sequence; identical to SEQ ID NO: 547
  Description of Artificial Sequence: Synthetic polypeptide
  XENP37230 Chain 2 - C6-30[CLDN6]_H1.22_(G4S)2_[ANTI-CD3]_L1.47 _H1.32_scFv(GKPGS)4_(G4S)2_Fc(222)_IgG1_PVA_/S267K/S364K/E357Q

SEQ ID NO: 551 - protein, 214 aa, Artificial Sequence; identical to SEQ ID NO: 184
  Description of Artificial Sequence: Synthetic polypeptide
  XENP37230 Chain 3 - C6-30[CLDN6]_H1.22

SEQ ID NO: 552 - protein, 449 aa, Artificial Sequence
  Description of Artificial Sequence: Synthetic polypeptide
  XENP37231 Chain 1 - C6-30[CLDN6]_H1.24_IgG1_pI(-)_Isosteric _A_PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYLGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 553 - protein, 722 aa, Artificial Sequence
  Description of Artificial Sequence: Synthetic polypeptide
  XENP37231 Chain 2 - C6-30[CLDN6]_H1.24_(G4S)2_[ANTI-CD3]_L1.47 _H1.32_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYLGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 554 - protein, 214 aa, Artificial Sequence; identical to SEQ ID NO: 454
  Description of Artificial Sequence: Synthetic polypeptide
  XENP37231 Chain 3 - C6-30[CLDN6]_H1.24

SEQ ID NO: 555 - protein, 449 aa, Artificial Sequence; identical to SEQ ID NO: 552
  Description of Artificial Sequence: Synthetic polypeptide
  XENP37232 Chain 1 - C6-30[CLDN6]_H1.24_IgG1_pI(-)_Isosteric _A_PVA_/S267K/L368D/K370S

SEQ ID NO: 556 - protein, 722 aa, Artificial Sequence; identical to SEQ ID NO: 553
  Description of Artificial Sequence: Synthetic polypeptide
  XENP37232 Chain 2 - C6-30[CLDN6]_H1.24_(G4S)2_[ANTI-CD3]_L1.47 _H1.32_scFv(GKPGS)4_(G4S)2_Fc(222)_IgG1_PVA_/S267K/S364K/E357Q

SEQ ID NO: 557 - protein, 214 aa, Artificial Sequence; identical to SEQ ID NO: 184
  Description of Artificial Sequence: Synthetic polypeptide
  XENP37232 Chain 3 - C6-30[CLDN6]_H1.24

SEQ ID NO: 558 - protein, 449 aa, Artificial Sequence
  Description of Artificial Sequence: Synthetic polypeptide
  XENP37233 Chain 1 - C6-30[CLDN6]_H2.91_IgG1_pI(-)_Isosteric _A_PVA_/S267K/L368D/K370S
EVQLVQSGAEVKKPGESLRISCKTSGYTFTEYTMHWVRQMPGKSLEWMGGIDPNNFNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 559 - protein, 722 aa, Artificial Sequence
  Description of Artificial Sequence: Synthetic polypeptide
  XENP37233 Chain 2 - C6-30[CLDN6]_H2.91_(G4S)2_[ANTI-CD3]_L1.47 _H1.32_scFv(GKPGS)4_(G4S)2_Fc(222)_IgG1_PVA_/S267K/S364K/E357Q
EVQLVQSGAEVKKPGESLRISCKTSGYTFTEYTMHWVRQMPGKSLEWMGGIDPNNFNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 560 - protein, 214 aa, Artificial Sequence; identical to SEQ ID NO: 454
  Description of Artificial Sequence: Synthetic polypeptide
  XENP37233 Chain 3 - C6-30[CLDN6]_H2.91

SEQ ID NO: 561 - protein, 449 aa, Artificial Sequence
  Description of Artificial Sequence: Synthetic polypeptide
  XENP37547 Chain 1 - C6-30[CLDN6]_H2.91_IgG1_pI(-)_Isosteric _A_PVA_/S267K/L368D/K370S
EVQLVQSGAEVKKPGESLRISCKTSGYTFTEYTMHWVRQMPGKSLEWMGGIDPNNFNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 562 - protein, 722 aa, Artificial Sequence
  Description of Artificial Sequence: Synthetic polypeptide
  XENP37547 Chain 2 - C6-30[CLDN6]_H2.91_(G4S)2_[anti-CD3]_L1.47_ H1.32_scFv(GKPGS)4_(G4S)2_Fc(222)_IgG1_PVA _/S267K/S364K/E357Q/M428L/N434S
EVQLVQSGAEVKKPGESLRISCKTSGYTFTEYTMHWVRQMPGKSLEWMGGIDPNNFNTHYNQKFQGHVTISVDKSISTAYLQWSSLKASDTAMYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 563 - protein, 214 aa, Artificial Sequence; identical to SEQ ID NO: 454
  Description of Artificial Sequence: Synthetic polypeptide
  XENP37547 Chain 3 - C6-30[CLDN6]_H2.91

SEQ ID NO: 564 - protein, 449 aa, Artificial Sequence
  Description of Artificial Sequence: Synthetic polypeptide
  XENP37545 Chain 1 - C6-30[CLDN6]_H1.24_IgG1_pI(-)_Isosteric_A _PVA_/S267K/L368D/K370S
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYLGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 565 - protein, 722 aa, Artificial Sequence
  Description of Artificial Sequence: Synthetic polypeptide
  XENP37545 Chain 2 - C6-30[CLDN6]_H1.24_(G4S)2_[anti-CD3]_L1.47_H1 .32_scFv(GKPGS)4_(G4S)2_Fc(222)_IgG1_PVA_/ S267K/S364K/E357Q/M428L/N434S
QVQLVQSGAEVKKPGASVKVSCKTSGYTFTEYTMHWVRQAPGQSLEWMGGIDPNNGNTHYNQKFQGRVTITVDKSASTAYMELSSLRSEDTAVYYCARIYYLGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 566 - protein, 214 aa, Artificial Sequence; identical to SEQ ID NO: 454
  Description of Artificial Sequence: Synthetic polypeptide
  XENP37545 Chain 3 - C6-30[CLDN6]_H1.24

SEQ ID NO: 567 - protein, 449 aa, Artificial Sequence
  Description of Artificial Sequence: Synthetic polypeptide
  XENP37541 Chain 1 - C6-30[CLDN6]_H1.9_IgG1_pI(-)_Isosteric_A _PVA_/S267K/L368D/K370S
QVQLVQSGAEVKKPGASVKVSCKTSGYTFTEYTMHWVRQAPGQSLEWMGGIDPNNANTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 568 - protein, 722 aa, Artificial Sequence
  Description of Artificial Sequence: Synthetic polypeptide
  XENP37541 Chain 2 - C6-30[CLDN6]_H1.9_(G4S)2_[anti-CD3]_L1.47_H1. 32_scFv(GKPGS)4_(G4S)2_Fc(222)_IgG1_PVA_/S267K/S364K/E357Q/M428L /N434S
QVQLVQSGAEVKKPGASVKVSCKTSGYTFTEYTMHWVRQAPGQSLEWMGGIDPNNANTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 569 - protein, 214 aa, Artificial Sequence; identical to SEQ ID NO: 454
  Description of Artificial Sequence: Synthetic polypeptide
  XENP37541 Chain 3 - C6-30[CLDN6]_H1.9

SEQ ID NO: 570 - protein, 449 aa, Artificial Sequence; identical to SEQ ID NO: 540
  Description of Artificial Sequence: Synthetic polypeptide
  XENP37630 Chain 1 - C6-30[CLDN6]_H1.9_IgG1_pI(-)_Isosteric _A_PVA_/S267K/L368D/K370S

SEQ ID NO: 571 - protein, 722 aa, Artificial Sequence
  Description of Artificial Sequence: Synthetic polypeptide
  XENP37630 Chain 2 - C6-30[CLDN6]_H1.9_(G4S)2_[anti-CD3]_L1.47_H1. 89_scFv(GKPGS)4_(G4S)2_Fc(222)_IgG1_PVA_/S267K/S364K/E357Q
QVQLVQSGAEVKKPGASVKVSCKTSGYTFTEYTMHWVRQAPGQSLEWMGGIDPNNANTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 572 - protein, 214 aa, Artificial Sequence; identical to SEQ ID NO: 454
  Description of Artificial Sequence: Synthetic polypeptide
  XENP37630 Chain 3 - C6-30[CLDN6]_H1.9

SEQ ID NO: 573 - protein, 449 aa, Artificial Sequence; identical to SEQ ID NO: 567
  Description of Artificial Sequence: Synthetic polypeptide
  XENP37634 Chain 1 - C6-30[CLDN6]_H1.9_IgG1_pI(-)_Isosteric_A_PVA _/S267K/L368D/K370S/M428L/N434S

SEQ ID NO: 574 - protein, 722 aa, Artificial Sequence
  Description of Artificial Sequence: Synthetic polypeptide
  XENP37634 Chain 2 - C6-30[CLDN6]_H1.9_(G4S)2_[anti-CD3]_L1.47_H1. 89_scFv(GKPGS)4_(G4S)2_Fc(222)_IgG1_PVA_/S267K/S364K/E357Q/M428L /N434S
QVQLVQSGAEVKKPGASVKVSCKTSGYTFTEYTMHWVRQAPGQSLEWMGGIDPNNANTHYNQKFQGRVTITVDKSASTAYMELSSLRSEDTAVYYCARIYYFGRLYFDFWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 575 - protein, 214 aa, Artificial Sequence; identical to SEQ ID NO: 454
  Description of Artificial Sequence: Synthetic polypeptide
  XENP37634 Chain 3 - C6-30[CLDN6]_H1.9

SEQ ID NO: 576 - protein, 723 aa, Artificial Sequence
  Description of Artificial Sequence: Synthetic polypeptide
  XENP37217 Chain 1-_ Comp_CH02[CLDN6]_H0_Fab_(G4S)2_SP34_L1.47_H1. 32_scFv(GKPGS)4_(G4S)2 -Fc(222)_IgG1_PVA_/S267K/S364K/E357Q
EVQVEQSGLELVKPGASVKISCKTSGYTFTEYTMHWVKQSHGKSLEWIGGINPNNGNTRYNQKFKDKATLTVDKSSRTAYMELHTLTSEDSAVYYCARCGDYDLFFFFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 577 - protein, 450 aa, Artificial Sequence
  Description of Artificial Sequence: Synthetic polypeptide
  XENP37217_Comp_CH02[CLDN6]_H0_Fab -IgG1_pI(-)_Isosteric_A_PVA _S267KL368DK370S
EVQVEQSGLELVKPGASVKISCKTSGYTFTEYTMHWVKQSHGKSLEWIGGINPNNGNTRYNQKFKDKATLTVDKSSRTAYMELHTLTSEDSAVYYCARCGDYDLFFFFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 578 - protein, 214 aa, Artificial Sequence
  Description of Artificial Sequence: Synthetic polypeptide
  XENP37217_Comp_CH02[CLDN6]_L0_Light Chain
DIVMTQFQKFMSTSVGDRVSVTCKASQNVGTNVAWYQQKPGQSPEALISSASSRFSGVPDRFTGSGSGTDFTLTITNVQSEDLADYFCQQYNSFPFTFGSGTELEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 579 - protein, 449 aa, Artificial Sequence
  Description of Artificial Sequence: Synthetic polypeptide
  XENP38084 Chain 1-_Comp_CH02[CLDN6]_H0_Heavy Chain
EVQVEQSGLELVKPGASVKISCKTSGYTFTEYTMHWVKQSHGKSLEWIGGINPNNGNTRYNQKFKDKATLTVDKSSRTAYMELHTLTSEDSAVYYCARCGDYDLFFFFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 580 - protein, 214 aa, Artificial Sequence; identical to SEQ ID NO: 578
  Description of Artificial Sequence: Synthetic polypeptide
  XENP38084 Chain 2-_Comp_CH02[CLDN6]_H0_L0

What is claimed is:

1. A composition comprising a bispecific antibody that binds human CD3 and human CLDN6 comprising:
    a) a first monomer comprising the amino acid sequence set forth in SEQ ID NO: 567;
    b) a second monomer comprising the amino acid sequence set forth in SEQ ID NO: 568; and
    c) a third monomer comprising the amino acid sequence set forth in SEQ ID NO: 569.

2. A nucleic acid composition comprising:
    a) a first nucleic acid encoding said first monomer of claim 1;
    b) a second nucleic acid encoding said second monomer claim 1; and
    c) a third nucleic acid encoding said third monomer of claim 1.

3. An expression vector composition comprising:
    a) a first expression vector comprising said first nucleic acid of claim 2;
    b) a second expression vector comprising said second nucleic acid of claim 2; and
    c) a third expression vector comprising said third nucleic acid of claim 2.

4. A host cell comprising said expression vector composition of claim 3.

5. A method of making a composition according to claim 1 comprising culturing said host cell of claim 4 under conditions wherein said composition of claim 1 is expressed, and recovering said composition.

* * * * *